United States Patent
Ruohola-Baker et al.

(10) Patent No.: US 9,416,369 B2
(45) Date of Patent: Aug. 16, 2016

(54) METHODS AND COMPOSITIONS TO MODULATE RNA PROCESSING

(71) Applicant: University of Washington Through Its Center for Commercialization, Seattle, WA (US)

(72) Inventors: Hannele Ruohola-Baker, Seattle, WA (US); Pratyusha Banik, Bothell, WA (US); Alan Beem, Seattle, WA (US); Sandra Shannon, Sammamish, WA (US); Henrik Sperber, Seattle, WA (US)

(73) Assignee: UNIVERSITY OF WASHINGTON THROUGH ITS CENTER FOR COMMERCIALIZATION, Seattle, WA (US)

( * ) Notice: Subject to any disclaimer, the term of this patent is extended or adjusted under 35 U.S.C. 154(b) by 0 days.

(21) Appl. No.: 14/652,756

(22) PCT Filed: Dec. 18, 2013

(86) PCT No.: PCT/US2013/076256
§ 371 (c)(1),
(2) Date: Jun. 16, 2015

(87) PCT Pub. No.: WO2014/100252
PCT Pub. Date: Jun. 26, 2014

(65) Prior Publication Data
US 2015/0337332 A1 Nov. 26, 2015

Related U.S. Application Data

(60) Provisional application No. 61/738,821, filed on Dec. 18, 2012.

(51) Int. Cl.
| | |
|---|---|
| *C07H 21/02* | (2006.01) |
| *C07H 21/04* | (2006.01) |
| *A61K 48/00* | (2006.01) |
| *C12N 15/63* | (2006.01) |
| *C12N 15/85* | (2006.01) |
| *C12N 15/113* | (2010.01) |
| *C12N 9/22* | (2006.01) |

(52) U.S. Cl.
CPC *C12N 15/85* (2013.01); *C12N 9/22* (2013.01); *C12N 15/113* (2013.01); *C12Y 301/26003* (2013.01); *C12N 15/63* (2013.01); *C12N 2310/14* (2013.01); *C12N 2310/141* (2013.01); *C12N 2310/351* (2013.01); *C12N 2310/533* (2013.01)

(58) Field of Classification Search
CPC ........... C12N 2310/533; C12N 15/113; C12N 2310/11
See application file for complete search history.

(56) References Cited

U.S. PATENT DOCUMENTS 7,232,806 B2    6/2007 Tuschl et al.

OTHER PUBLICATIONS

Abdelmohsen K, Srikantan S, Kang MJ, Gorospe M. 2012. Regulation of senescence by microRNA biogenesis factors. Ageing Res Rev 11(4): 491-500.
Anokye-Danso F, Trivedi CM, Juhr D, Gupta M, Cui Z, Tian Y, Zhang Y, Yang W, Gruber PJ, Epstein JA et al. 2011. Highly efficient miRNA-mediated reprogramming of mouse and human somatic cells to pluripotency. Cell Stem Cell 8(4): 376-388.
Bar M, Wyman SK, Fritz BR, Qi J, Garg KS, Parkin RK, Kroh EM, Bendoraite A, Mitchell PS, Nelson AM et al. 2008. MicroRNA discovery and profiling in human embryonic stem cells by deep sequencing of small RNA libraries. Stem Cells 26(10): 2496-2505.
Bartel DP. 2004. MicroRNAs: genomics, biogenesis, mechanism, and function. Cell 116(2): 281-297.
Basyuk E, Suavet F, Doglio A, Bordonne R, Bertrand E. 2003. Human let-7 stem-loop precursors harbor features of RNase III cleavage products. Nucleic Acids Res 31(22): 6593-6597.
Berezikov E, Chung WJ, Willis J, Cuppen E, Lai EC. 2007. Mammalian mirtron genes. Mol Cell 28(2): 328-336.
Bernstein E, Allis CD. 2005. RNA meets chromatin. Genes Dev 19(14): 1635-1655.
Borchert GM, Lanier W, Davidson BL. 2006. RNA polymerase III transcribes human microRNAs. Nat Struct Mol Biol 13(12): 1097-1101.
Brueckner B, Stresemann C, Kuner R, Mund C, Musch T, Meister M, Sultmann H, Lyko F. 2007. The human let-7a-3 locus contains an epigenetically regulated microRNA gene with oncogenic function. Cancer Res 67(4): 1419-1423.
Chambers SM, Fasano CA, Papapetrou EP, Tomishima M, Sadelain M, Studer L. 2009. Highly efficient neural conversion of human ES and iPS cells by dual inhibition of SMAD signaling. Nat Biotechnol 27(3): 275-280.
Cheloufi S, Dos Santos CO, Chong MM, Hannon GJ. 2010. A dicer-independent miRNA biogenesis pathway that requires Ago catalysis. Nature 465(7298): 584-589.
Chendrimada TP, Gregory RI, Kumaraswamy E, Norman J, Cooch N, Nishikura K, Shiekhattar R. 2005. TRBP recruits the Dicer complex to Agog for microRNA processing and gene silencing. Nature 436(7051): 740-744.
Chong MM, Zhang G, Cheloufi S, Neubert TA, Hannon GJ, Littman DR. 2010. Canonical and alternate functions of the microRNA biogenesis machinery. Genes Dev 24(17): 1951-1960.
Cullen BR. 2006. Viruses and microRNAs. Nat Genet 38 Suppl: S25-30.
Davis BN, Hata A. 2009. Regulation of MicroRNA Biogenesis: A miRiad of mechanisms. Cell Commun Signal 7: 18.

(Continued)

*Primary Examiner* — Amy Bowman
(74) *Attorney, Agent, or Firm* — K&L Gates LLP; Louis C. Cullman; Michelle Glasky Bergman

(57) ABSTRACT

The present disclosure provides methods and compositions to selectively modulate RNA processing. The methods and compositions selectively enhance or repress RNA processing by up- or down-regulating Drosha expression and/or by providing RNA sequences with mis-matches introduced or removed 5 and/or 9-12 nucleotide positions from the Drosha cutting site. Therapeutic uses of the methods and compositions are also described.

13 Claims, 22 Drawing Sheets

(56) References Cited

OTHER PUBLICATIONS

Diederichs S, Haber DA. 2006. Sequence variations of microRNAs in human cancer: alterations in predicted secondary structure do not affect processing. Cancer Res 66(12): 6097-6104.
Du T, Zamore PD. 2005. microPrimer: the biogenesis and function of microRNA. Development 132(21): 4645-4652.
Duan R, Pak C, Jin P. 2007. Single nucleotide polymorphism associated with mature miR-125a alters the processing of pri-miRNA. Hum Mol Genet 16(9): 1124-1131.
Feng Y, Zhang X, Graves P, Zeng Y. 2012. A comprehensive analysis of precursor microRNA cleavage by human Dicer. RNA 18(11): 2083-2092.
Feng Y, Zhang X, Song Q, Li T, Zeng Y. 2011. Drosha processing controls the specificity and efficiency of global . microRNA expression. Biochim Biophys Acta 1809(11-12): 700-707.
Fukuda T, Yamagata K, Fujiyama S, Matsumoto T, Koshida I, Yoshimura K, Mihara M, Naitou M, Endoh H, Nakamura T et al. 2007. Dead-box RNA helicase subunits of the Drosha complex are required for processing of rRNA and a subset of microRNAs. Nat Cell Biol 9(5): 604-611.
Gregory RI, Yan KP, Amuthan G, Chendrimada T, Doratotaj B, Cooch N, Shiekhattar R. 2004. The Microprocessor complex mediates the genesis of microRNAs. Nature 432(7014): 235-240.
Griffiths-Jones S, Grocock RJ, van Dongen S, Bateman A, Enright AJ. 2006. miRBase: microRNA sequences, targets and gene nomenclature. Nucleic Acids Res 34(Database issue): D140-144.
Han J, Pedersen JS, Kwon SC, Belair CD, Kim YK, Yeom KK, Yang WY, Haussler D, Blelloch R, Kim VN. 2009. Posttranscriptional crossregulation between Drosha and DGCR8. Cell 136(1): 75-84.
Hatfield SD, Shcherbata HR, Fischer KA, Nakahara K, Carthew RW, Ruohola-Baker H. 2005. Stem cell division is regulated by the microRNA pathway. Nature 435(7044): 974-978.
Hofacker IL, Fontana W, Stadler PF, Bonhoeffer LS, Tacker M, Schuster P. 1994. Fast folding and comparison of RNA secondary structures. Monatsh Chem 125: 167-188.
Hutvagner G, McLachlan J, Pasquinelli AE, Balint E, Tuschl T, Zamore PD. 2001. A cellular function for the RNA-interference enzyme Dicer in the maturation of the let-7 small temporal RNA. Science 293(5531): 834-838.
Kim VN, Nam JW. 2006. Genomics of microRNA. Trends Genet 22(3): 165-173.
Kuehbacher A, Urbich C, Zeiher AM, Dimmeler S. 2007. Role of Dicer and Drosha for endothelial microRNA expression and angiogenesis. Circ Res 101(1): 59-68.
Kuppusamy KT, Sperber H, Ruohola-Baker H. 2013. MicroRNA Regulation and role in stem cell maintenance, cardiac differentiation and hypertrophy. Curr Mol Med Submitted.
Lagos-Quintana M, Rauhut R, Lendeckel W, Tuschl T. 2001. Identification of novel genes coding for small expressed RNAs. Science 294(5543): 853-858.
Lee Y, Ahn C, Han J, Choi H, Kim J, Yim J, Lee J, Provost P, Radmark O, Kim S et al. 2003. The nuclear RNase III Drosha initiates microRNA processing. Nature 425(6956): 415-419.
Mattick JS, Makunin IV. 2006. Non-coding RNA. Hum Mol Genet 15 Spec No. 1: R17-29.
Nam Y, Chen C, Gregory RI, Chou JJ, Sliz P. 2011. Molecular basis for interaction of let-7 microRNAs with Lin28. Cell 147(5): 1080-1091.
Noland CL, Ma E, Doudna JA. 2011. siRNA repositioning for guide strand selection by human Dicer complexes. Mol Cell 43(1): 110-121.
O'Donnell KA, Wentzel EA, Zeller KI, Dang CV, Mendell JT. 2005. c-Myc-regulated microRNAs modulate E2F1 expression. Nature 435(7043): 839-843.
Qi J, Yu JY, Shcherbata HR, Mathieu J, Wang AJ, Seal S, Zhou W, Stadler BM, Bourgin D, Wang L et al. 2009. microRNAs regulate human embryonic stem cell division. Cell Cycle 8(22): 3729-3741.
Ritchie W, Legendre M, Gautheret D. 2007. RNA stem-loops: to be or not to be cleaved by RNAse III. RNA 13(4): 457-462.
Ruby JG, Jan CH, Bartel DP. 2007. Intronic microRNA precursors that bypass Drosha processing. Nature 448(7149): 83-86.
Shcherbata HR, Hatfield S, Ward EJ, Reynolds S, Fischer KA, Ruohola-Baker H. 2006. The MicroRNA pathway plays a regulatory role in stem cell division. Cell Cycle 5(2): 172-175.
Stadler B, Ivanovska I, Mehta K, Song S, Nelson A, Tan Y, Mathieu J, Darby C, Blau CA, Ware C et al. 2010. Characterization of microRNAs involved in embryonic stem cell states. Stem Cells Dev 19(7): 935-950.
Stadler BM, Ruohola-Baker H. 2008. Small RNAs: keeping stem cells in line. Cell 132(4): 563-566.
Starega-Roslan J, Krol J, Koscianska E, Kozlowski P, Szlachcic WJ, Sobczak K, Krzyzosiak WJ. 2010. Structural basis of microRNA length variety. Nucleic Acids Res 39(1): 257-268.
Stark A, Brennecke J, Bushati N, Russell RB, Cohen SM. 2005. Animal MicroRNAs confer robustness to gene expression and have a significant impact on 3'UTR evolution. Cell 123(6): 1133-1146.
Sun G, Yan J, Noltner K, Feng J, Li H, Sarkis DA, Sommer SS, Rossi JJ. 2009. SNPs in human miRNA genes affect biogenesis and function. RNA 15(9): 1640-1651.
Takada S, Berezikov E, Yamashita Y, Lagos-Quintana M, Kloosterman WP, Enomoto M, Hatanaka H, Fujiwara S, Watanabe H, Soda M et al. 2006. Mouse microRNA profiles determined with a new and sensitive cloning method. Nucleic Acids Res 34(17): e115.
Wu M, Jolicoeur N, Li Z, Zhang L, Fortin Y, L'Abbe D, Yu Z, Shen SH. 2008. Genetic variations of microRNAs in human cancer and their effects on the expression of miRNAs. Carcinogenesis 29(9): 1710-1716.
Zeng Y, Cullen BR. 2003. Sequence requirements for micro RNA processing and function in human cells. RNA 9(1): 112-123.
Zisoulis DG, Kai ZS, Chang RK, Pasquinelli AE. 2012. Autoregulation of microRNA biogenesis by let-7 and Argonaute. Nature 486(7404): 541-544.
Mora et al. 'Enzymatic microRNA detection in microtiter plates with DNA dendrimers. Bio Techniques'. 41(4). pp 420-424. Oct. 2006.
Sperber et al. 'miRNA sensitivity to Drosha levels correlates with pre-miRNA secondly structure'. RNA. 20. pp. 621-631. Mar. 27, 2014.
Karathanasis et al. 'A bioinformatics. approach for investigating the determinants of Drosha processing'. In proceedings of the 13th IEEE International Conference on Bioinformatics and Bioengineering (IEEE BIBE 2013) Nov. 10-13, Chania, Greece. pp. 1-4. Article retrieved from the internet. URL: https://www.mensxmachina.org/files/publications/KarathanasisBIBE13.pdf.
Xing et al. 'cis-Acting Effects on RNA Processing and Drosha Cleavage Prevent Epstein-Barr Virus Latency III BHRF1 Expression'. Journal of Virology. vol. 85, No. 17. pp. 8929-8939. Sep. 2011.
Han et al. 'Molecular Basis for the Recognition of Primary microRNAs by the Drosha-DGCR8 Complex'. Cell. vol. 125. pp. 887-901. Jun. 2, 2006.
Zeng et al. 'Recognition and cleavage of primary microRNA precursors by the nuclear processing enzyme Drosha'. The EMBO Journal. vol. 24, Issue 1. pp. 138-148. Jan. 2005.
PCT/US2013/076256. International Search Report and Written Opinion. May 12, 2014.
Han, J., et al. "The Drosha-DGCR8 complex in primary microRNA processing", Genes Dev 18(24): 3016-27; 2004.
Shcherbata, H.R.. et al., "Stage-Specific Differences in the Requirements for Germline Stem Cell Maintenance in the Drosophila Ovary", Cell Stem Cell 1(6): 698-709, 2007.
Sohn, S.Y., et al., "Crystal Structure of Human DGCR8 Core", Nat Struct Mol Biol 14(9): 847-53, 2007.
Uhlen, M.P., et al., "Towards a Knowledge-Based Human Protein Atlas", Nat Biotechnol. 28(12): 1248-50, 2010.
Westholm, J.O., et al., "Mirtrons:microRNA biogenesis via splicing", Biochimie 93, 1897-1904, 2011.
Winter, J.S., et al., "Many roads to maturity: microRNA biogenesis pathways and their regulation", Nat Cell Biol., 11 (3): 228-34, 2009.

A
Drosha expression in HeLa cells, measured by qPCR, 7 biological replicates

B
Drosha protein expression in HeLa cells hsa-let-7a-1 MI0000060

UGGGAUGAGGUAGUAGGUUGUAUAGUUUUAGGGUCACACCCACCACUGG
GAGAUAACUAUACAAUCUACUGUCUUUCCUA

```
        u    gu                    uuagggucacac
   uggga gag    aguagguuguauaguu               c
   ||||| |||    ||||||||||||||||               c
   auccu uuc    ucaucuaacauaucaa               a
        ug                        uagagggucacc
```

Mismatched positions: 1, 5, 6

Fig 17A hsa-let-7a-2 MI0000061

AGGUUGAGGUAGUAGGUUGUAUAGUUUAGAAUUACAUCAAGGGAGAUAA
CUGUACAGCCUCCUAGCUUUCCU

```
     uu   g   u             uagaa  ua a
   agg  gag uag  agguuguauaguu      u c u
   |||  ||| |||  ||||||||||||||     | | c
   ucc  uuc auc  uccgacaugucaa      a g a
    -u   g   c              --uag  gg a
```

Mismatched positions: 1, 5, 9

Fig 17B hsa-let-7a-3 MI0000062
GGGUGAGGUAGUAGGUUGUAUAGUUUGGGGCUCUGCCCUGCUAUGGGA
UAACUAUACAAUCUACUGUCUUUCCU

```
         u    gu                              ‐ ‐ ‐ ‐ ‐ ‐
  ggg   gag   aguagguuguauaguu               uggggcu
  |||   |||   ||||||||||||||||                |||||| c
  ucc   uuc   ucaucuaacauaucaa               gucccgu
         u    ug                              uaggguauc
```

Mismatched positions: 1, 5, 6

Fig 17C hsa-let-7b MI0000063
CGGGGUGAGGUAGUAGGUUGUGUGGUUUCAGGGCAGUGAUGUUGCCCC
UCGGAAGAUAACUAUACAACCUACUGCCUUCCCUG

```
      u                            ucagggcagugaug
  cgggg   gagguaguagguugugugguu                    u
  |||||   |||||||||||||||||||||||
  guccc   uuccgucaucaacauaucaa                    u
      ‐                            uagaaggcucccg
```

Mismatched position: 1

Fig 17D hsa-let-7c MI0000064

GCAUCCGGGUUGAGGUAGUAGGUUGUAUGGUUUAGAGUUACACCCUGG
GAGUUAACUGUACAACCUUCUAGCUUUCCUUGGAGC

```
         a     uu    g    u                    ua   g  ua a
      gc uccggg   gag  uag  agguuguaugguu    ga  u   c  c
      || ||||||   |||  |||  ||||||||||||    ||  |   |  c
      cg agguuc   uuc  auc  uccaacaugucaa    uu  a   g  c
       -         cu    g    u                --   g  gg u
```

Mismatched positions: 1, 5, 9

Fig 17E hsa-let-7d MI0000065

CCUAGGAAGAGGUAGUAGGUUGCAUAGUUUUAGGGCAGGGAUUUUGCCCACAAGGAGG
UAACUAUACGACCUGCUGCCUUUCUUAGG

```
     a               c         uuagggcagggauu
ccuagga gagguaguagguug auaguu                   u
|||||||  ||||||||||||| ||||||
ggauucu uuccgucguccagc uaucaa                   u
   -              a         uggaggaacacccg
```

Mismatched positions: 1, 16

Fig 17F hsa-let-7e MI0000066

CCCGGGCUGAGGUAGGAGGUUGUAUAGUUGAGGAGGACACCCAAGGAG
AUCACUAUACGGCCUCCUAGCUUUCCCAGG

```
        c    cu   g                        u   ----gga    a
   cc ggg   gag  uaggagguuguauagu ga               gg   c
   || |||   |||  |||||||||||||||| ||                ||   |
   gg ccc   uuc  aucguccggcauauca cu               cc   a
        a    cu   g                   -    agaggaa    c
```

Mismatched positions: 1, 5, 22

Fig 17G hsa-let-7f-1 MI0000067

UCAGAGUGAGGUAGUAGAUUGUAUAGUUGUGGGGUAGUGAUUUUACCC
UGUUCAGGAGAUAACUAUACAAUCUAUUGCCUUCCCUGA

```
      a  ug                              ---------        u
   ucag  g   agguaguagauuguauaguugu           gggguag   g
   ||||  |   ||||||||||||||||||||||           |||||||    a
   aguc  c   ucgguaucuaacauaucaaua           ucccauu   u
      -  cu                       gaggacuug         u
```

Mismatched positions: 1, 2

Fig 17H hsa-let-7f-2 MI0000068

UGUGGGAUGAGGUAGUAGAUUGUAUAGUUUUAGGGUCAUACCCCAUCUU
GGAGAUAACUAUACAGUCUACUGUCUUUCCCACG

```
u       u    gu                  uuagggucauac
guggga  gag  aguagauuguauaguu                 c
||||||  |||  |||||||||||||||
cacccu  uuc  ucaucugacauaucaa                 c
g       -    ug                  uagagguucuac
```

Mismatched positions: 1, 5, 6

Fig 17 I hsa-let-7g MI0000433

AGGCUGAGGUAGUAGUUUGUACAGUUUGAGGGUCUAUGAUACCACCCGG
UACAGGAGAUAACUGUACAGGCCACUGCCUUGCCA

```
a    u        a                ugagg  -a   a     a
ggc  gagguagu quuuguacaguu            gucu  ug  uacc  c
|||  ||||||||  ||||||||||||           ||||   |  ||||
ccg  uuccguca  cggacaugucaa           uaga  ac  augg  c
a    -        c                -----  gg   -    c
```

Mismatched positions: 1, 10

Fig 17J hsa-let-7i MI0000434

CUGGCUGAGGUAGUAGUUUGUGCUGUUGGUCGGGUUGUGACAUUGCCC
GCUGUGGAGAUAACUGCGCAAGCUACUGCCUUGCUA

```
     c    u                         u    --------  u       ugu
  uggc gagguaguaguuugugc guu            gg  cgggu      g
  ||||  |||||||||||||||| |||            ||  |||||      a
  aucg uucggucaucgaacgcg caa            uc  gcccg      c
     -    -                         u    uagaggug  -    uua
```

Mismatched positions: 1, 19

Fig 17K

METHODS AND COMPOSITIONS TO MODULATE RNA PROCESSING

CROSS REFERENCE TO RELATED APPLICATION

This application is a national phase of PCT/US2013/076256 filed on 18 Dec. 2013 which claims priority to U.S. 61/738,821 filed on 18 Dec. 2012, the entire disclosures of both of which are incorporated by reference herein.

STATEMENT OF GOVERNMENT INTEREST

This invention was made with government support under grant no. R01 GM083867, awarded by the National Institutes of Health (NIH). The government has certain rights in the invention.

FIELD OF THE DISCLOSURE

The present disclosure provides methods and compositions to selectively modulate RNA processing. The methods and compositions selectively enhance or repress RNA processing by up- or down-regulating Drosha expression and/or by providing RNA sequences with mis-matches introduced or removed 5 and/or 9-12 nucleotide positions from the Drosha cutting site. Therapeutic uses of the methods and compositions are also described.

BACKGROUND OF THE DISCLOSURE

Generally, for a protein to exert an effect, the cell that will use or secrete the protein must create it. To create a protein the cell first makes a copy of the protein's gene sequence in the nucleus of the cell. This copy of the gene sequence that encodes for the protein (called messenger RNA ("mRNA")) leaves the nucleus and is trafficked to a region of the cell containing ribosomes. Ribosomes read the sequence of the mRNA and create the protein for which it encodes. This process of new protein synthesis is known as translation. A variety of factors affect the rate and efficiency of protein translation. Among the most significant of these factors is the intrinsic stability of the mRNA itself. If the mRNA is degraded quickly within the cell (such as before it reaches a ribosome), it is unable to serve as a template for new protein translation, thus reducing the cell's ability to create the protein for which it encoded.

MicroRNAs (miRNA which also include isomiRs) are a group of short, non-coding RNAs that bind target mRNAs to either inhibit their translation or reduce their stability. miRNAs are transcribed in the nucleus as part of a primary microRNA (pri-miRNA). The length of pri-miRNAs is highly variable, ranging from ~200 up to several thousand nucleotides (nt). pri-miRNAs are cleaved by the cellular Microprocessor complex, which consists of several components, principally Drosha and DGCR8. Drosha and DGCR8 cooperatively bind pri-miRNA, and Drosha cleaves the primary pri-miRNA transcript at ~11 base pairs from the base of the stem-loop, liberating a structure known as the precursor microRNA (pre-miRNA).

pre-miRNA is ~60-70 nt in length and forms a frequently mismatched hairpin structure with a 2 nt 3' overhang. The pre-miRNA is transported from the nucleus to the cytoplasm and is subsequently cleaved by the enzyme Dicer with its cofactor trans-activator RNA (tar)-binding protein (TRBP). Dicer binds the 3'-overhang and cleaves the pre-miRNA ~22 nt from the Drosha-cutting site to remove the terminal loop resulting in an imperfect ~22 nt miRNA/miRNA* duplex. The miRNA enters the RNA-induced silencing complex (RISC), whereas the miRNA* strand is degraded. While the Drosha and Dicer processing mechanisms are described in relation to miRNA, the same mechanisms can process various other RNA types as well including mRNA.

RNAs, including miRNAs, are involved with the onset of various diseases, immunoregulation, neural growth and stem cell renewal and maintenance. RNA levels can be regulated in several ways. For example, pri-miRNA transcription is regulated by common DNA transcription factors, e.g. c-Myc. The Microprocessor complex contains several components besides Drosha and DGCR8, such as the DEAD-box helicases p68 and p72, which have been proposed to stabilize the Microprocessor complex. Other components of the Microprocessor include SMAD proteins which have been found to selectively upregulate certain RNAs, e.g. mir-21. The DGCR8 mRNA has stem loop structures that can be cleaved by the Microprocessor, accordingly giving DGCR8 a self regulating mechanism.

SUMMARY OF THE DISCLOSURE

The current disclosure provides methods and compositions to selectively enhance or repress RNA processing by up- or down-regulating Drosha expression and/or by providing RNA sequences with mis-matches introduced or removed 5 and/or 9-12 nucleotide (nt) positions from the Drosha cutting site. Particularly, the disclosure shows that altered Drosha expression levels can selectively regulate RNAs with particular secondary structures. More particularly, the current disclosure shows that RNA with fewer mismatches located 5 nt and/or 9-12 nt from the Drosha cutting site show greater resilience to reduced Drosha expression (i.e., their cleavage is less affected by reduced Drosha expression). On the other hand, RNA with more mismatches 5 nt and/or 9-12 nt from the Drosha cutting site show reduced cleavage (decreased levels) when Drosha levels are reduced and are thus less resilient to reduced Drosha expression. The current disclosure also shows that Drosha expression fluctuates during development and across different cell types. Understanding this novel mechanism of RNA regulation as well as the fluctuating levels of Drosha expression during development and across cell types allows one to up- or down-regulate Drosha expression to affect RNAs that are expressed within a cell. Conversely or in addition, one can predict changed RNA expression during development and/or in particular cell types and can selectively up- or down-regulate RNA during times of low or high natural expression. The current disclosure also provides for the strategic design of RNAs that can be more or less resilient to changing Drosha expression. Each of these mechanisms provide avenues for intelligent therapeutic design.

BRIEF DESCRIPTION OF THE FIGURES

FIG. 17. Drosha cutting sites and mis-match positions for: A (hsa-let-7a-1; MI0000060); B (hsa-let-7a-2; MI0000061); C (hsa-let-7a-3; MI0000062); D (hsa-let-7b; MI0000063); E (hsa-let-7c; MI0000064); F (hsa-let-7d; MI0000065); G (hsa-let-7e; MI0000066); H (hsa-let-7f-1; MI0000067); I (hsa-let-7f-2; MI0000068); J (hsa-let-7g; MI0000433) and K (hsa-let-7i; MI0000434).

DETAILED DESCRIPTION

Figure 1:
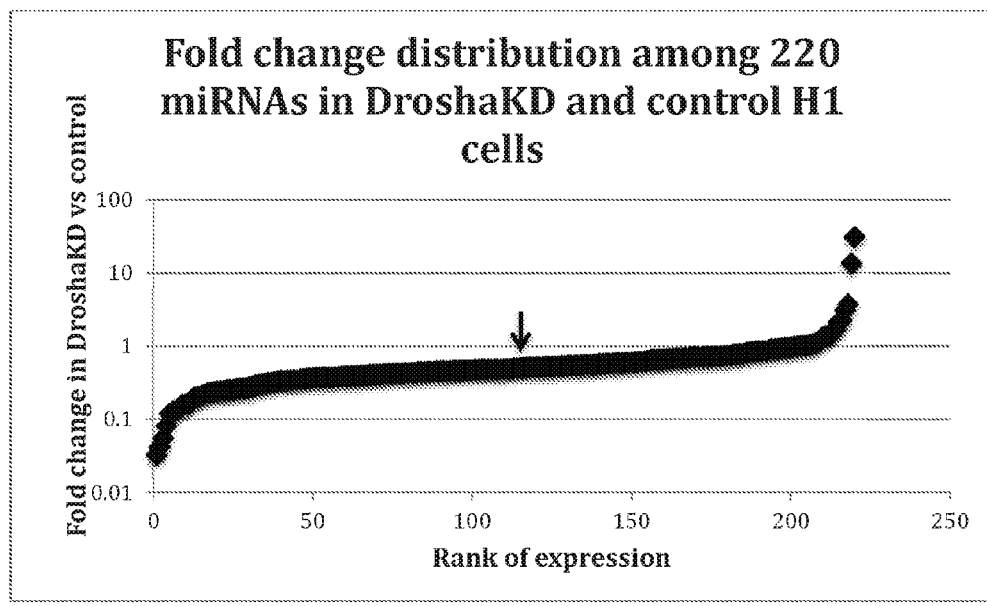
FIG. 1. Fold change of miRNA expression between Drosha knockdown and control H1 hESC for 220 miRNAs assayed by qPCR. Arrow marks median (0.495).

Ribonucleic acid (RNA) is a ubiquitous family of large biological molecules that perform multiple vital roles in the coding, decoding, regulation, and expression of genes. Common types of RNA include double-stranded (dsRNA), double-stranded with a single-stranded overhang, heterogeneous nuclear RNA, messenger RNA (mRNA), micro RNA (miRNA), small nucleolar RNA (snoRNA), ribosomal RNA (rRNA), short interfering RNA (sRNA), small nuclear RNA (snRNA), single-stranded RNA (ssRNA), small hairpin RNA (shRNA), Piwi-interacting RNA (piRNA), transfer RNA (tRNA), long non-coding RNA (lncRNA), long non-coding intergenic RNA (lincRNA) and viral RNA. Particular RNA molecules can fall into more than one RNA type. As used herein, the term "RNA" includes all types of RNA including those listed as the preceding examples and all forms of RNA known to those of ordinary skill in the art. "RNA" can also include any type of nucleic acid polymer that is processed by Drosha or Dicer.

MicroRNAs (miRNA) are a group of short, non-coding RNAs that bind target mRNAs by incomplete complementarity to either inhibit the translation, or reduce the stability of the target mRNA. miRNAs are involved with the onset of various diseases, immunoregulation, neural growth and stem cell renewal and maintenance. Currently 1,872 microRNAs are known to exist in human and many of these are evolutionarily conserved.

miRNAs are transcribed in the nucleus by RNA polymerase II or III as part of a primary microRNA (pri-miRNA).

The length of the pri-miRNA is highly variable, ranging from ~200 up to several thousand nucleotides. The pri-miRNA is cleaved by the Microprocessor, which consists of several components principally Drosha and DGCR8. Drosha and DGCR8 cooperatively bind pri-miRNA, and Drosha cleaves primary transcripts at ~11 base pairs from the base of the stem-loop and liberates a structure known as the precursor microRNA (pre-miRNA), which is ~60-70 nucleotides in length and forms a frequently mismatched hairpin structure with a ~2 nucleotide 3' overhang. A "stem-loop structure" refers to a nucleic acid having a secondary structure that includes a region of nucleotides which are known or predicted to form a double strand (stem portion) that is linked on one side by a region of predominantly single-stranded nucleotides (loop portion). The terms "hairpin" and "fold-back" structures are also used herein to refer to stem-loop structures. Such structures are well known in the art and the term is used consistently with its known meaning in the art. The actual primary sequence of nucleotides within the stem-loop structure is not critical as long as the secondary structure is present (See FIG. 3A). As is known in the art, the secondary structure does not require exact base-pairing. Thus, the stem may include one or more base mismatches. Alternatively, the base-pairing may be exact, i.e. not include any mismatches.

pre-miRNA is transported from the nucleus to the cytoplasm by Exportin-5 and is subsequently cleaved by the enzyme Dicer with its cofactor trans-activator RNA (tar)-binding protein (TRBP). Dicer binds the 3'-overhang and cleaves the pri-miRNA ~22 nt from the Drosha-cutting site to remove the terminal loop resulting in an imperfect ~22 nt miRNA/miRNA* duplex. The miRNA enters the RNA-induced silencing complex (RISC), whereas the miRNA* strand is degraded. While this processing mechanism is described in relation to miRNA, it may also apply to all other forms of RNA and nucleic acid polymers processed by Drosha and Dicer.

RNA levels can be regulated in several ways. For example, pri-miRNA transcription is regulated by common transcription factors such as c-Myc. The Microprocessor complex contains several components besides Drosha and DGCR8, such as the DEAD-box helicases p68 and p72, which have been proposed to stabilize the Microprocessor complex. Other components of the Microprocessor include SMAD proteins which have been found to selectively upregulate certain RNAs such as mir-21. The DGCR8 mRNA has stem loop structures that can be cleaved by the Microprocessor, accordingly giving DGCR8 a self regulating mechanism.

The present disclosure shows that decreasing Drosha expression leads to heterogeneous changes in the expression of RNA. The global but non-uniform impact of Drosha knockdown on RNA expression shows that RNAs are not processed by Drosha at equal rates. Non-uniform processing effects indicate that there is some structural relationship between the Microprocessor and the RNAs it cleaves, and any other associated proteins, which could explain the effects of Drosha-knockdown on expression of specific RNAs.

Figure 2:
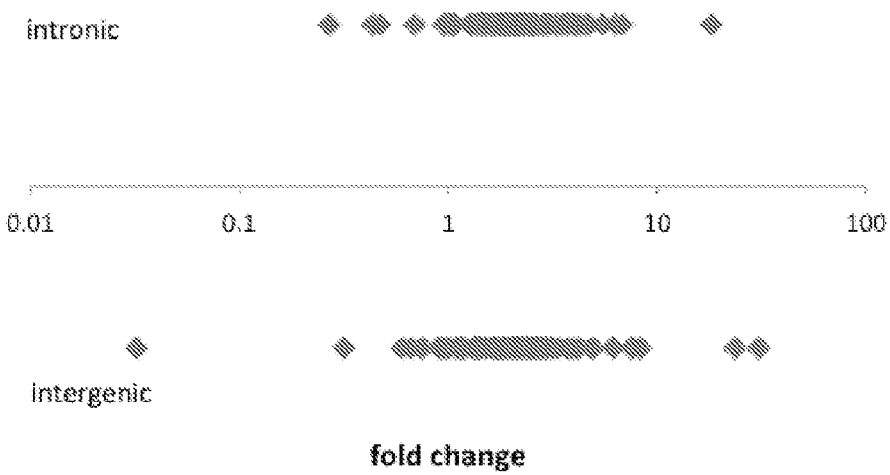
FIG. 2. Fold change of expression for miRNAs between Drosha knockdown and Control H1 hESC for 220 miRNAs assayed by qPCR and grouped by genomic origin (intergenic/intronic).

Particular proteins interact with the Microprocessor and/or RNAs to promote or inhibit processing of RNAs. Without being bound by a particular theory, it is possible that protein-based effects explain much of the variation seen in the Drosha knockdown datasets. However, such specific interactions could be considered as part of a complex feed-back mechanism triggered by Drosha-knockdown. In an effort to quantify broad, global mechanisms, which control RNA biogenesis, the genomic origin of 220 miRNAs was first investigated (some miRNAs skip Drosha-processing). Intronic miRNAs were not expressed differently from intergenic miRNAs (FIG. 2). Given that differences in expression were not explained by genomic origin, the secondary structure of RNAs was examined.

Examination of the secondary structure of RNAs was achieved by a counting mechanism and showed that the group of RNAs unaffected or upregulated by Drosha KD had less mismatched bases 5 nt and 9-12 nt from the Drosha cutting site. Additionally, the method of counting resulted in a very consistent measurement of 21 nt, which is consistent with previous reports indicating that Dicer processing of pre-miRNAs with asymmetric mismatches seems to explain the heterogeneity of length observed amongst mature miRNAs, and is also consistent with the idea that Dicer processing utilizes 'molecular rulers' which are size invariant. A general mechanism which modulates the Drosha processing step in RNA biogenesis based on differences in secondary structure has not been previously described. However, the structure of DGCR8 suggests that the RNA is bound in a bent position. Mismatches would affect the strain of a bent RNA. Without being bound by a particular theory, the present disclosure suggests that when Drosha levels are limiting, RNAs with fewer mis-matches in positions 5 and 9-12 from the Drosha cutting site are processed more efficiently than RNAs with more mis-matches in positions 5 and 9-12 from the Drosha cutting site.

Drosha cutting sites can be identified by those of ordinary skill in the art. In one embodiment, Drosha cutting sites are derived by comparison of hairpin sequences versus mature 5' miRNA sequences. The following table provides hairpin sequences associated with mature 5' miRNA sequences for Drosha cutting site calculation. The beginning of the mature 5' miRNAs corresponds to the Drosha cutting site.

TABLE 1

Exemplary full hairpin and mature 5' miRNA sequences, with positions 5 and 9-12, as determined by the counting methods described herein, shown in bold.

| miRNA name | Full Hairpin Sequence | Mature 5' Sequence |
|---|---|---|
| let-7a-1 | UGGGAUGAGGUAGUAGGUUGUAUAGUU UUAGGGUCACACCCACCACUGGGAGAU AACUAUACAAUCUACUGUCUUUCCUA (SEQ ID NO: 1) | UGAGGUAGUAGGU UGUAUAGUU (SEQ ID NO: 1873) |
| let-7b | CGGGGUGAGGUAGUAGGUUGUGUGGUU UCAGGGCAGUGAUGUUGCCCCUCGGAA GAUAACUAUACAACCUACUGCCUUCCC UG (SEQ ID NO: 4) | UGAGGUAGUAGGU UGUGUGGUU (SEQ ID NO: 1874) |
| let-7c | GCAUCCGGGUUGAGGUAGUAGGUUGUA UGGUUUAGAGUUACACCCUGGGAGUUA ACUGUACAACCUUCUAGCUUUCCUUGG AGC (SEQ ID NO: 5) | UGAGGUAGUAGGU UGUAUAGUU (SEQ ID NO: 1875) |
| let-7d | CCUAGGAAGAGGUAGUAGGUUGCAUAG UUUUAGGGCAGGGAUUUUGCCCACAAG GAGGUAACUAUACGACCUGCUGCCUUU CUUAGG (SEQ ID NO: 6) | AGAGGUAGUAGGU UGCAUAGUU (SEQ ID NO: 1876) |
| let-7e | CCCGGGCUGAGGUAGGAGGUUGUAUAG UUGAGGAGGACACCCAAGGAGAUCACU AUACGGCCUCCUAGCUUUCCCCAGG (SEQ ID NO: 7) | UGAGGUAGGAGGU UGUAUAGUU (SEQ ID NO: 1877) |
| let-7f-1 | UCAGAGUGAGGUAGUAGAUUGUAUAGU UGUGGGGUAGUGAUUUUACCCUGUUCA GGAGAUAACUAUACAAUCUAUUGCCUU CCCUGA (SEQ ID NO: 8) | UGAGGUAGUAGAU UGUAUAGUU (SEQ ID NO: 1878) |

TABLE 1-continued

Exemplary full hairpin and mature 5' miRNA sequences, with positions 5 and 9-12, as determined by the counting methods described herein, shown in bold.

| miRNA name | Full Hairpin Sequence | Mature 5' Sequence |
|---|---|---|
| let-7g | AGGCUGAGGUAGUAGUUUGUACAGUUU GAGGGUCUAUGAUACCACCCGGUACAG GAGAUAACUGUACAGGCCACUGCCUUG CCA (SEQ ID NO: 10) | UGAGGUAGUAGUU UGUACAGUU (SEQ ID NO: 1879) |
| let-7i | CUGGCUGAGGUAGUAGUUUGUGCUGUU GGUCGGGUUGUGACAUUGCCCGCUGUG GAGAUAACUGCGCAAGCUACUGCCUUG CUA (SEQ ID NO: 11) | UGAGGUAGUAGUU UGUGCUGUU (SEQ ID NO: 1880) |
| miR-21 | UGUCGGGUAGCUUAUCAGACUGAUGUU GACUGUUGAAUCUCAUGGCAACACCAG UCGAUGGGCUGUCUGACA (SEQ ID NO: 130) | UAGCUUAUCAGAC UGAUGUUGA (SEQ ID NO: 2021) |
| miR-126 | CGCUGGCGACGGGACAUUAUUACUUUU GGUACGCGCUGUGACACUUCAAACUCG UACCGUGAGUAAUAAUGCGCCGUCCAC GGCA (SEQ ID NO: 35) | CAUUAUUACUUUU GGUACGCG (SEQ ID NO: 1914) |
| miR-152 | UGUCCCCCCCGGCCCAGGUUCUGUGAU ACACUCCGACUCGGGCUCUGGAGCAGU CAGUGCAUGACAGAACUUGGGCCCGGA AGGACC (SEQ ID NO: 72) | AGGUUCUGUGAUA CACUCCGACU (SEQ ID NO: 1960) |

The calculation as described in the preceding table can be performed based on the hairpin and mature 5' sequences of the sequences provided in this disclosure's sequence listing. The following combinations of sequences provide related hairpin and mature 5' sequences.

| Name | Hairpin | Mature 5' | Name | Hairpin | Mature 5' |
|---|---|---|---|---|---|
| let-7a-1 | SEQ ID NO: 1 | SEQ ID NO: 1873 | mir-16-2 | SEQ ID NO: 80 | SEQ ID NO: 1967 |
| let-7a-2 | SEQ ID NO: 2 | SEQ ID NO: 1873 | mir-17 | SEQ ID NO: 81 | SEQ ID NO: 1968 |
| let-7a-3 | SEQ ID NO: 3 | SEQ ID NO: 1873 | mir-18a | SEQ ID NO: 95 | SEQ ID NO: 1979 |
| let-7b | SEQ ID NO: 4 | SEQ ID NO: 1874 | mir-18b | SEQ ID NO: 96 | SEQ ID NO: 1980 |
| let-7c | SEQ ID NO: 5 | SEQ ID NO: 1875 | mir-19a | SEQ ID NO: 114 | SEQ ID NO: 1999 |
| let-7d | SEQ ID NO: 6 | SEQ ID NO: 1876 | mir-19b-1 | SEQ ID NO: 115 | SEQ ID NO: 2000 |
| let-7e | SEQ ID NO: 7 | SEQ ID NO: 1877 | mir-19b-2 | SEQ ID NO: 116 | SEQ ID NO: 2001 |
| let-7f-1 | SEQ ID NO: 8 | SEQ ID NO: 1878 | mir-20a | SEQ ID NO: 128 | SEQ ID NO: 2011 |
| let-7f-2 | SEQ ID NO: 9 | SEQ ID NO: 1878 | mir-20b | SEQ ID NO: 129 | SEQ ID NO: 2012 |
| let-7g | SEQ ID NO: 10 | SEQ ID NO: 1879 | mir-21 | SEQ ID NO: 130 | SEQ ID NO: 2021 |
| let-7i | SEQ ID NO: 11 | SEQ ID NO: 1880 | mir-22 | SEQ ID NO: 144 | SEQ ID NO: 2031 |
| mir-7-3 | SEQ ID NO: 279 | SEQ ID NO: 2708 | mir-23a | SEQ ID NO: 149 | SEQ ID NO: 2035 |
| mir-7-2 | SEQ ID NO: 278 | SEQ ID NO: 2708 | mir-23b | SEQ ID NO: 150 | SEQ ID NO: 2036 |
| mir-7-1 | SEQ ID NO: 277 | SEQ ID NO: 2708 | mir-24-2 | SEQ ID NO: 153 | SEQ ID NO: 2038 |
| mir-9-3 | SEQ ID NO: 286 | SEQ ID NO: 2739 | mir-24-1 | SEQ ID NO: 152 | SEQ ID NO: 2037 |
| mir-9-2 | SEQ ID NO: 281 | SEQ ID NO: 2739 | mir-25 | SEQ ID NO: 154 | SEQ ID NO: 2040 |
| mir-9-1 | SEQ ID NO: 280 | SEQ ID NO: 2739 | mir-26a-1 | SEQ ID NO: 155 | SEQ ID NO: 2043 |
| mir-10a | SEQ ID NO: 24 | SEQ ID NO: 1887 | mir-26a-2 | SEQ ID NO: 156 | SEQ ID NO: 2043 |
| mir-10b | SEQ ID NO: 25 | SEQ ID NO: 1888 | mir-26b | SEQ ID NO: 157 | SEQ ID NO: 2044 |
| mir-15a | SEQ ID NO: 77 | SEQ ID NO: 1965 | mir-27a | SEQ ID NO: 158 | SEQ ID NO: 2045 |
| mir-15b | SEQ ID NO: 78 | SEQ ID NO: 1966 | mir-27b | SEQ ID NO: 159 | SEQ ID NO: 2046 |
| mir-16-1 | SEQ ID NO: 79 | SEQ ID NO: 1967 | mir-28 | SEQ ID NO: 160 | SEQ ID NO: 2047 |
| mir-29a | SEQ ID NO: 165 | SEQ ID NO: 2050 | mir-96 | SEQ ID NO: 288 | SEQ ID NO: 2740 |
| mir-29b-1 | SEQ ID NO: 166 | SEQ ID NO: 2051 | mir-98 | SEQ ID NO: 289 | SEQ ID NO: 2741 |
| mir-29b-2 | SEQ ID NO: 167 | SEQ ID NO: 2052 | mir-99a | SEQ ID NO: 290 | SEQ ID NO: 2742 |
| mir-29c | SEQ ID NO: 168 | SEQ ID NO: 2053 | mir-99b | SEQ ID NO: 291 | SEQ ID NO: 2743 |
| mir-30a | SEQ ID NO: 178 | SEQ ID NO: 2062 | mir-100 | SEQ ID NO: 12 | SEQ ID NO: 1881 |
| mir-30b | SEQ ID NO: 179 | SEQ ID NO: 2063 | mir-101-2 | SEQ ID NO: 14 | SEQ ID NO: 1882 |
| mir-30c-1 | SEQ ID NO: 180 | SEQ ID NO: 2064 | mir-101-1 | SEQ ID NO: 13 | SEQ ID NO: 1882 |
| mir-30c-2 | SEQ ID NO: 181 | SEQ ID NO: 2064 | mir-103a-2 | SEQ ID NO: 16 | SEQ ID NO: 1883 |
| mir-30d | SEQ ID NO: 182 | SEQ ID NO: 2065 | mir-105-2 | SEQ ID NO: 20 | SEQ ID NO: 1884 |
| mir-30e | SEQ ID NO: 183 | SEQ ID NO: 2066 | mir-105-1 | SEQ ID NO: 19 | SEQ ID NO: 1884 |
| mir-31 | SEQ ID NO: 184 | SEQ ID NO: 2086 | mir-106a | SEQ ID NO: 21 | SEQ ID NO: 1885 |
| mir-32 | SEQ ID NO: 185 | SEQ ID NO: 2104 | mir-106b | SEQ ID NO: 22 | SEQ ID NO: 1886 |
| mir-33a | SEQ ID NO: 208 | SEQ ID NO: 2113 | mir-122 | SEQ ID NO: 28 | SEQ ID NO: 1896 |
| mir-33b | SEQ ID NO: 209 | SEQ ID NO: 2114 | mir-124-3 | SEQ ID NO: 31 | SEQ ID NO: 1906 |
| mir-34a | SEQ ID NO: 214 | SEQ ID NO: 2118 | mir-124-2 | SEQ ID NO: 30 | SEQ ID NO: 1906 |
| mir-34b | SEQ ID NO: 215 | SEQ ID NO: 2119 | mir-124-1 | SEQ ID NO: 29 | SEQ ID NO: 1906 |
| mir-34c | SEQ ID NO: 216 | SEQ ID NO: 2120 | mir-125a | SEQ ID NO: 32 | SEQ ID NO: 1912 |
| mir-92a-1 | SEQ ID NO: 282 | SEQ ID NO: 2731 | mir-125b-1 | SEQ ID NO: 33 | SEQ ID NO: 1913 |
| mir-92a-2 | SEQ ID NO: 283 | SEQ ID NO: 2732 | mir-125b-2 | SEQ ID NO: 34 | SEQ ID NO: 1913 |
| mir-92b | SEQ ID NO: 284 | SEQ ID NO: 2733 | mir-126 | SEQ ID NO: 35 | SEQ ID NO: 1914 |
| mir-93 | SEQ ID NO: 285 | SEQ ID NO: 2734 | mir-127 | SEQ ID NO: 36 | SEQ ID NO: 1919 |
| mir-95 | SEQ ID NO: 287 | SEQ ID NO: 2738 | mir-128-1 | SEQ ID NO: 37 | SEQ ID NO: 1921 |
| mir-128-2 | SEQ ID NO: 38 | SEQ ID NO: 1922 | mir-146a | SEQ ID NO: 62 | SEQ ID NO: 1953 |
| mir-129-2 | SEQ ID NO: 40 | SEQ ID NO: 1928 | mir-146b | SEQ ID NO: 63 | SEQ ID NO: 1954 |
| mir-129-1 | SEQ ID NO: 39 | SEQ ID NO: 1928 | mir-148a | SEQ ID NO: 66 | SEQ ID NO: 1955 |
| mir-130a | SEQ ID NO: 41 | SEQ ID NO: 1935 | mir-148b | SEQ ID NO: 67 | SEQ ID NO: 1956 |
| mir-130b | SEQ ID NO: 42 | SEQ ID NO: 1936 | mir-149 | SEQ ID NO: 68 | SEQ ID NO: 1957 |
| mir-132 | SEQ ID NO: 43 | SEQ ID NO: 1937 | mir-150 | SEQ ID NO: 69 | SEQ ID NO: 1958 |
| mir-133a-1 | SEQ ID NO: 44 | SEQ ID NO: 1938 | mir-151a | SEQ ID NO: 70 | SEQ ID NO: 1959 |
| mir-133a-2 | SEQ ID NO: 45 | SEQ ID NO: 1938 | mir-152 | SEQ ID NO: 72 | SEQ ID NO: 1960 |
| mir-134 | SEQ ID NO: 47 | SEQ ID NO: 1940 | mir-153-2 | SEQ ID NO: 74 | SEQ ID NO: 1961 |
| mir-135a-1 | SEQ ID NO: 48 | SEQ ID NO: 1941 | mir-153-1 | SEQ ID NO: 73 | SEQ ID NO: 1961 |
| mir-135a-2 | SEQ ID NO: 49 | SEQ ID NO: 1941 | mir-154 | SEQ ID NO: 75 | SEQ ID NO: 1963 |

| Name | Hairpin | Mature 5' | Name | Hairpin | Mature 5' | Name | Hairpin | Mature 5' | Name | Hairpin | Mature 5' |
|---|---|---|---|---|---|---|---|---|---|---|---|
| mir-135b | SEQ ID NO: 50 | SEQ ID NO: 1942 | mir-155 | SEQ ID NO: 76 | SEQ ID NO: 1964 | mir-323a | SEQ ID NO: 194 | SEQ ID NO: 2101 | mir-370 | SEQ ID NO: 224 | SEQ ID NO: 2156 |
| mir-136 | SEQ ID NO: 51 | SEQ ID NO: 1943 | mir-181a-1 | SEQ ID NO: 82 | SEQ ID NO: 1969 | mir-323b | SEQ ID NO: 195 | SEQ ID NO: 2102 | mir-371a | SEQ ID NO: 225 | SEQ ID NO: 2157 |
| mir-138-2 | SEQ ID NO: 54 | SEQ ID NO: 1944 | mir-181a-2 | SEQ ID NO: 83 | SEQ ID NO: 1969 | mir-324 | SEQ ID NO: 196 | SEQ ID NO: 2103 | mir-371b | SEQ ID NO: 226 | SEQ ID NO: 2158 |
| mir-138-1 | SEQ ID NO: 53 | SEQ ID NO: 1944 | mir-181b-1 | SEQ ID NO: 84 | SEQ ID NO: 1970 | mir-328 | SEQ ID NO: 199 | SEQ ID NO: 2105 | mir-372 | SEQ ID NO: 227 | SEQ ID NO: 2159 |
| mir-139 | SEQ ID NO: 55 | SEQ ID NO: 1945 | mir-181b-2 | SEQ ID NO: 85 | SEQ ID NO: 1970 | mir-329-2 | SEQ ID NO: 201 | SEQ ID NO: 2106 | mir-373 | SEQ ID NO: 228 | SEQ ID NO: 2160 |
| mir-140 | SEQ ID NO: 56 | SEQ ID NO: 1946 | mir-181c | SEQ ID NO: 86 | SEQ ID NO: 1971 | mir-329-1 | SEQ ID NO: 200 | SEQ ID NO: 2106 | mir-374a | SEQ ID NO: 229 | SEQ ID NO: 2161 |
| mir-141 | SEQ ID NO: 57 | SEQ ID NO: 1947 | mir-181d | SEQ ID NO: 87 | SEQ ID NO: 1972 | mir-330 | SEQ ID NO: 202 | SEQ ID NO: 2107 | mir-374b | SEQ ID NO: 230 | SEQ ID NO: 2162 |
| mir-142 | SEQ ID NO: 58 | SEQ ID NO: 1948 | mir-182 | SEQ ID NO: 88 | SEQ ID NO: 1973 | mir-331 | SEQ ID NO: 203 | SEQ ID NO: 2108 | mir-374c | SEQ ID NO: 231 | SEQ ID NO: 2163 |
| mir-143 | SEQ ID NO: 59 | SEQ ID NO: 1949 | mir-183 | SEQ ID NO: 89 | SEQ ID NO: 1974 | mir-335 | SEQ ID NO: 204 | SEQ ID NO: 2109 | mir-376a-1 | SEQ ID NO: 233 | SEQ ID NO: 2165 |
| mir-144 | SEQ ID NO: 60 | SEQ ID NO: 1950 | mir-185 | SEQ ID NO: 91 | SEQ ID NO: 1975 | mir-337 | SEQ ID NO: 205 | SEQ ID NO: 2110 | mir-376a-2 | SEQ ID NO: 234 | SEQ ID NO: 2164 |
| mir-145 | SEQ ID NO: 61 | SEQ ID NO: 1951 | mir-186 | SEQ ID NO: 92 | SEQ ID NO: 1976 | mir-338 | SEQ ID NO: 206 | SEQ ID NO: 2111 | mir-376b | SEQ ID NO: 235 | SEQ ID NO: 2166 |
| mir-187 | SEQ ID NO: 93 | SEQ ID NO: 1977 | mir-204 | SEQ ID NO: 123 | SEQ ID NO: 2007 | mir-339 | SEQ ID NO: 207 | SEQ ID NO: 2112 | mir-376c | SEQ ID NO: 236 | SEQ ID NO: 2167 |
| mir-188 | SEQ ID NO: 94 | SEQ ID NO: 1978 | mir-205 | SEQ ID NO: 124 | SEQ ID NO: 2008 | mir-340 | SEQ ID NO: 210 | SEQ ID NO: 2115 | mir-377 | SEQ ID NO: 237 | SEQ ID NO: 2168 |
| mir-190a | SEQ ID NO: 97 | SEQ ID NO: 1983 | mir-208a | SEQ ID NO: 126 | SEQ ID NO: 2009 | mir-342 | SEQ ID NO: 211 | SEQ ID NO: 2116 | mir-378a | SEQ ID NO: 238 | SEQ ID NO: 2169 |
| mir-191 | SEQ ID NO: 99 | SEQ ID NO: 1988 | mir-208b | SEQ ID NO: 127 | SEQ ID NO: 2010 | mir-345 | SEQ ID NO: 212 | SEQ ID NO: 2117 | mir-379 | SEQ ID NO: 249 | SEQ ID NO: 2170 |
| mir-192 | SEQ ID NO: 100 | SEQ ID NO: 1989 | mir-210 | SEQ ID NO: 131 | SEQ ID NO: 2013 | mir-361 | SEQ ID NO: 217 | SEQ ID NO: 2128 | mir-380 | SEQ ID NO: 250 | SEQ ID NO: 2171 |
| mir-193a | SEQ ID NO: 101 | SEQ ID NO: 1990 | mir-211 | SEQ ID NO: 132 | SEQ ID NO: 2016 | mir-362 | SEQ ID NO: 218 | SEQ ID NO: 2135 | mir-381 | SEQ ID NO: 251 | SEQ ID NO: 2172 |
| mir-193b | SEQ ID NO: 102 | SEQ ID NO: 1991 | mir-212 | SEQ ID NO: 133 | SEQ ID NO: 2018 | mir-382 | SEQ ID NO: 252 | SEQ ID NO: 2173 | mir-486-2 | SEQ ID NO: 300 | SEQ ID NO: 2323 |
| mir-194-2 | SEQ ID NO: 104 | SEQ ID NO: 1992 | mir-214 | SEQ ID NO: 134 | SEQ ID NO: 2019 | mir-383 | SEQ ID NO: 253 | SEQ ID NO: 2174 | mir-486 | SEQ ID NO: 299 | SEQ ID NO: 2323 |
| mir-194-1 | SEQ ID NO: 103 | SEQ ID NO: 1992 | mir-215 | SEQ ID NO: 135 | SEQ ID NO: 2020 | mir-409 | SEQ ID NO: 255 | SEQ ID NO: 2185 | mir-487a | SEQ ID NO: 301 | SEQ ID NO: 2324 |
| mir-195 | SEQ ID NO: 105 | SEQ ID NO: 1993 | mir-216a | SEQ ID NO: 136 | SEQ ID NO: 2022 | mir-410 | SEQ ID NO: 256 | SEQ ID NO: 2186 | mir-487b | SEQ ID NO: 302 | SEQ ID NO: 2325 |
| mir-196a-1 | SEQ ID NO: 106 | SEQ ID NO: 1994 | mir-216b | SEQ ID NO: 137 | SEQ ID NO: 2023 | mir-411 | SEQ ID NO: 257 | SEQ ID NO: 2187 | mir-488 | SEQ ID NO: 303 | SEQ ID NO: 2326 |
| mir-196a-2 | SEQ ID NO: 107 | SEQ ID NO: 1994 | mir-218-2 | SEQ ID NO: 140 | SEQ ID NO: 2024 | mir-412 | SEQ ID NO: 258 | SEQ ID NO: 2188 | mir-489 | SEQ ID NO: 304 | SEQ ID NO: 2327 |
| mir-196b | SEQ ID NO: 108 | SEQ ID NO: 1995 | mir-218-1 | SEQ ID NO: 139 | SEQ ID NO: 2024 | mir-423 | SEQ ID NO: 261 | SEQ ID NO: 2189 | mir-490 | SEQ ID NO: 305 | SEQ ID NO: 2328 |
| mir-197 | SEQ ID NO: 109 | SEQ ID NO: 1996 | mir-219a-1 | SEQ ID NO: 141 | SEQ ID NO: 2025 | mir-424 | SEQ ID NO: 262 | SEQ ID NO: 2190 | mir-491 | SEQ ID NO: 306 | SEQ ID NO: 2329 |
| mir-199a-1 | SEQ ID NO: 111 | SEQ ID NO: 1997 | mir-219a-2 | SEQ ID NO: 142 | SEQ ID NO: 2025 | mir-425 | SEQ ID NO: 263 | SEQ ID NO: 2191 | mir-493 | SEQ ID NO: 308 | SEQ ID NO: 2330 |
| mir-199a-2 | SEQ ID NO: 112 | SEQ ID NO: 1997 | mir-219b | SEQ ID NO: 143 | SEQ ID NO: 2026 | mir-431 | SEQ ID NO: 265 | SEQ ID NO: 2192 | mir-494 | SEQ ID NO: 309 | SEQ ID NO: 2331 |
| mir-199b | SEQ ID NO: 113 | SEQ ID NO: 1998 | mir-221 | SEQ ID NO: 145 | SEQ ID NO: 2027 | mir-432 | SEQ ID NO: 266 | SEQ ID NO: 2193 | mir-495 | SEQ ID NO: 310 | SEQ ID NO: 2332 |
| mir-200a | SEQ ID NO: 117 | SEQ ID NO: 2002 | mir-222 | SEQ ID NO: 146 | SEQ ID NO: 2028 | mir-433 | SEQ ID NO: 267 | SEQ ID NO: 2194 | mir-497 | SEQ ID NO: 312 | SEQ ID NO: 2333 |
| mir-200b | SEQ ID NO: 118 | SEQ ID NO: 2003 | mir-223 | SEQ ID NO: 147 | SEQ ID NO: 2029 | mir-449b | SEQ ID NO: 270 | SEQ ID NO: 2203 | mir-499a | SEQ ID NO: 314 | SEQ ID NO: 2335 |
| mir-200c | SEQ ID NO: 119 | SEQ ID NO: 2004 | mir-224 | SEQ ID NO: 148 | SEQ ID NO: 2030 | mir-449c | SEQ ID NO: 271 | SEQ ID NO: 2204 | mir-499b | SEQ ID NO: 315 | SEQ ID NO: 2336 |
| mir-202 | SEQ ID NO: 120 | SEQ ID NO: 2005 | mir-296 | SEQ ID NO: 161 | SEQ ID NO: 2048 | mir-450a-1 | SEQ ID NO: 272 | SEQ ID NO: 2205 | mir-500a | SEQ ID NO: 316 | SEQ ID NO: 2346 |
| mir-203b | SEQ ID NO: 122 | SEQ ID NO: 2006 | mir-299 | SEQ ID NO: 164 | SEQ ID NO: 2049 | mir-450a-2 | SEQ ID NO: 273 | SEQ ID NO: 2205 | mir-500b | SEQ ID NO: 317 | SEQ ID NO: 2347 |
| mir-301a | SEQ ID NO: 170 | SEQ ID NO: 2054 | mir-363 | SEQ ID NO: 219 | SEQ ID NO: 2136 | mir-450b | SEQ ID NO: 274 | SEQ ID NO: 2206 | mir-501 | SEQ ID NO: 318 | SEQ ID NO: 2350 |
| mir-302a | SEQ ID NO: 172 | SEQ ID NO: 2055 | mir-365a | SEQ ID NO: 220 | SEQ ID NO: 2137 | mir-452 | SEQ ID NO: 292 | SEQ ID NO: 2211 | mir-502 | SEQ ID NO: 319 | SEQ ID NO: 2351 |
| mir-302b | SEQ ID NO: 173 | SEQ ID NO: 2056 | mir-365b | SEQ ID NO: 221 | SEQ ID NO: 2138 | mir-454 | SEQ ID NO: 293 | SEQ ID NO: 2214 | mir-503 | SEQ ID NO: 320 | SEQ ID NO: 2352 |
| mir-302c | SEQ ID NO: 174 | SEQ ID NO: 2057 | mir-367 | SEQ ID NO: 222 | SEQ ID NO: 2143 | mir-455 | SEQ ID NO: 294 | SEQ ID NO: 2215 | mir-504 | SEQ ID NO: 321 | SEQ ID NO: 2353 |
| mir-302d | SEQ ID NO: 175 | SEQ ID NO: 2058 | mir-369 | SEQ ID NO: 223 | SEQ ID NO: 2155 | mir-483 | SEQ ID NO: 296 | SEQ ID NO: 2321 | mir-505 | SEQ ID NO: 322 | SEQ ID NO: 2354 |

| Name | Hairpin | Mature 5' | Name | Hairpin | Mature 5' | Name | Hairpin | Mature 5' | Name | Hairpin | Mature 5' |
|---|---|---|---|---|---|---|---|---|---|---|---|
| mir-485 | SEQ ID NO: 298 | SEQ ID NO: 2322 | mir-506 | SEQ ID NO: 323 | SEQ ID NO: 2355 | mir-548ao | SEQ ID NO: 409 | SEQ ID NO: 2407 | mir-548h-1 | SEQ ID NO: 433 | SEQ ID NO: 2423 |
| mir-508 | SEQ ID NO: 325 | SEQ ID NO: 2356 | mir-517a | SEQ ID NO: 347 | SEQ ID NO: 2372 | mir-548ap | SEQ ID NO: 410 | SEQ ID NO: 2408 | mir-548h-2 | SEQ ID NO: 434 | SEQ ID NO: 2423 |
| mir-509-3 | SEQ ID NO: 328 | SEQ ID NO: 2359 | mir-517b | SEQ ID NO: 348 | SEQ ID NO: 2372 | mir-548aq | SEQ ID NO: 411 | SEQ ID NO: 2409 | mir-548h-3 | SEQ ID NO: 435 | SEQ ID NO: 2423 |
| mir-509-2 | SEQ ID NO: 327 | SEQ ID NO: 2360 | mir-517c | SEQ ID NO: 349 | SEQ ID NO: 2372 | mir-548ar | SEQ ID NO: 412 | SEQ ID NO: 2410 | mir-548h-4 | SEQ ID NO: 436 | SEQ ID NO: 2423 |
| mir-509-1 | SEQ ID NO: 326 | SEQ ID NO: 2360 | mir-518a-1 | SEQ ID NO: 350 | SEQ ID NO: 2375 | mir-548as | SEQ ID NO: 413 | SEQ ID NO: 2411 | mir-548h-5 | SEQ ID NO: 437 | SEQ ID NO: 2423 |
| mir-510 | SEQ ID NO: 329 | SEQ ID NO: 2361 | mir-518a-2 | SEQ ID NO: 351 | SEQ ID NO: 2375 | mir-548at | SEQ ID NO: 414 | SEQ ID NO: 2412 | mir-548j | SEQ ID NO: 442 | SEQ ID NO: 2424 |
| mir-511 | SEQ ID NO: 330 | SEQ ID NO: 2362 | mir-518c | SEQ ID NO: 353 | SEQ ID NO: 2376 | mir-548au | SEQ ID NO: 415 | SEQ ID NO: 2413 | mir-548o | SEQ ID NO: 447 | SEQ ID NO: 2425 |
| mir-512-2 | SEQ ID NO: 332 | SEQ ID NO: 2363 | mir-518d | SEQ ID NO: 354 | SEQ ID NO: 2377 | mir-548o-2 | SEQ ID NO: 448 | SEQ ID NO: 2425 | mir-593 | SEQ ID NO: 507 | SEQ ID NO: 2460 |
| mir-512-1 | SEQ ID NO: 331 | SEQ ID NO: 2363 | mir-518e | SEQ ID NO: 355 | SEQ ID NO: 2378 | mir-548t | SEQ ID NO: 452 | SEQ ID NO: 2426 | mir-597 | SEQ ID NO: 510 | SEQ ID NO: 2461 |
| mir-513a-1 | SEQ ID NO: 333 | SEQ ID NO: 2364 | mir-518f | SEQ ID NO: 356 | SEQ ID NO: 2379 | mir-548x | SEQ ID NO: 456 | SEQ ID NO: 2427 | mir-598 | SEQ ID NO: 511 | SEQ ID NO: 2462 |
| mir-513a-2 | SEQ ID NO: 334 | SEQ ID NO: 2364 | mir-519a-1 | SEQ ID NO: 357 | SEQ ID NO: 2383 | mir-548x-2 | SEQ ID NO: 457 | SEQ ID NO: 2427 | mir-605 | SEQ ID NO: 518 | SEQ ID NO: 2463 |
| mir-513b | SEQ ID NO: 335 | SEQ ID NO: 2365 | mir-519a-2 | SEQ ID NO: 358 | SEQ ID NO: 2383 | mir-550a-1 | SEQ ID NO: 461 | SEQ ID NO: 2429 | mir-615 | SEQ ID NO: 528 | SEQ ID NO: 2464 |
| mir-513c | SEQ ID NO: 336 | SEQ ID NO: 2366 | mir-519b | SEQ ID NO: 359 | SEQ ID NO: 2384 | mir-550a-2 | SEQ ID NO: 462 | SEQ ID NO: 2429 | mir-616 | SEQ ID NO: 529 | SEQ ID NO: 2465 |
| mir-514a-1 | SEQ ID NO: 337 | SEQ ID NO: 2367 | mir-519c | SEQ ID NO: 360 | SEQ ID NO: 2385 | mir-550a-3 | SEQ ID NO: 463 | SEQ ID NO: 2428 | mir-619 | SEQ ID NO: 532 | SEQ ID NO: 2466 |
| mir-514a-2 | SEQ ID NO: 338 | SEQ ID NO: 2367 | mir-519d | SEQ ID NO: 361 | SEQ ID NO: 2386 | mir-550b-2 | SEQ ID NO: 465 | SEQ ID NO: 2430 | mir-624 | SEQ ID NO: 537 | SEQ ID NO: 2467 |
| mir-514a-3 | SEQ ID NO: 339 | SEQ ID NO: 2367 | mir-519e | SEQ ID NO: 362 | SEQ ID NO: 2387 | mir-551b | SEQ ID NO: 467 | SEQ ID NO: 2431 | mir-625 | SEQ ID NO: 538 | SEQ ID NO: 2468 |
| mir-514b | SEQ ID NO: 340 | SEQ ID NO: 2368 | mir-520a | SEQ ID NO: 363 | SEQ ID NO: 2388 | mir-552 | SEQ ID NO: 468 | SEQ ID NO: 2432 | mir-627 | SEQ ID NO: 540 | SEQ ID NO: 2469 |
| mir-515-2 | SEQ ID NO: 342 | SEQ ID NO: 2369 | mir-520c | SEQ ID NO: 365 | SEQ ID NO: 2389 | mir-556 | SEQ ID NO: 472 | SEQ ID NO: 2433 | mir-628 | SEQ ID NO: 541 | SEQ ID NO: 2470 |
| mir-515-1 | SEQ ID NO: 341 | SEQ ID NO: 2369 | mir-520d | SEQ ID NO: 366 | SEQ ID NO: 2390 | mir-561 | SEQ ID NO: 476 | SEQ ID NO: 2448 | mir-629 | SEQ ID NO: 542 | SEQ ID NO: 2471 |
| mir-516a-1 | SEQ ID NO: 343 | SEQ ID NO: 2370 | mir-520f | SEQ ID NO: 368 | SEQ ID NO: 2391 | mir-570 | SEQ ID NO: 484 | SEQ ID NO: 2450 | mir-642a | SEQ ID NO: 555 | SEQ ID NO: 2472 |
| mir-516a-2 | SEQ ID NO: 344 | SEQ ID NO: 2370 | mir-520g | SEQ ID NO: 369 | SEQ ID NO: 2392 | mir-574 | SEQ ID NO: 488 | SEQ ID NO: 2451 | mir-642b | SEQ ID NO: 556 | SEQ ID NO: 2473 |
| mir-516b-1 | SEQ ID NO: 345 | SEQ ID NO: 2371 | mir-522 | SEQ ID NO: 373 | SEQ ID NO: 2393 | mir-576 | SEQ ID NO: 490 | SEQ ID NO: 2452 | mir-651 | SEQ ID NO: 565 | SEQ ID NO: 2492 |
| mir-516b-2 | SEQ ID NO: 346 | SEQ ID NO: 2371 | mir-523 | SEQ ID NO: 374 | SEQ ID NO: 2394 | mir-579 | SEQ ID NO: 493 | SEQ ID NO: 2453 | mir-652 | SEQ ID NO: 566 | SEQ ID NO: 2494 |
| mir-524 | SEQ ID NO: 375 | SEQ ID NO: 2395 | mir-548av | SEQ ID NO: 416 | SEQ ID NO: 2414 | mir-580 | SEQ ID NO: 494 | SEQ ID NO: 2454 | mir-653 | SEQ ID NO: 567 | SEQ ID NO: 2495 |
| mir-525 | SEQ ID NO: 376 | SEQ ID NO: 2396 | mir-548ay | SEQ ID NO: 419 | SEQ ID NO: 2415 | mir-582 | SEQ ID NO: 496 | SEQ ID NO: 2455 | mir-654 | SEQ ID NO: 568 | SEQ ID NO: 2496 |
| mir-526b | SEQ ID NO: 379 | SEQ ID NO: 2397 | mir-548az | SEQ ID NO: 420 | SEQ ID NO: 2416 | mir-584 | SEQ ID NO: 498 | SEQ ID NO: 2456 | mir-655 | SEQ ID NO: 569 | SEQ ID NO: 2497 |
| mir-532 | SEQ ID NO: 381 | SEQ ID NO: 2398 | mir-548b | SEQ ID NO: 421 | SEQ ID NO: 2417 | mir-585 | SEQ ID NO: 499 | SEQ ID NO: 2457 | mir-656 | SEQ ID NO: 570 | SEQ ID NO: 2498 |
| mir-539 | SEQ ID NO: 382 | SEQ ID NO: 2399 | mir-548ba | SEQ ID NO: 422 | SEQ ID NO: 2417 | mir-589 | SEQ ID NO: 503 | SEQ ID NO: 2458 | mir-659 | SEQ ID NO: 573 | SEQ ID NO: 2499 |
| mir-541 | SEQ ID NO: 383 | SEQ ID NO: 2400 | mir-548c | SEQ ID NO: 423 | SEQ ID NO: 2418 | mir-590 | SEQ ID NO: 504 | SEQ ID NO: 2459 | mir-660 | SEQ ID NO: 574 | SEQ ID NO: 2500 |
| mir-542 | SEQ ID NO: 384 | SEQ ID NO: 2401 | mir-548d-1 | SEQ ID NO: 424 | SEQ ID NO: 2419 | mir-664a | SEQ ID NO: 579 | SEQ ID NO: 2501 | mir-889 | SEQ ID NO: 611 | SEQ ID NO: 2728 |
| mir-545 | SEQ ID NO: 388 | SEQ ID NO: 2402 | mir-548d-2 | SEQ ID NO: 425 | SEQ ID NO: 2419 | mir-664b | SEQ ID NO: 580 | SEQ ID NO: 2502 | mir-891a | SEQ ID NO: 613 | SEQ ID NO: 2729 |
| mir-548a-1 | SEQ ID NO: 389 | SEQ ID NO: 2403 | mir-548e | SEQ ID NO: 426 | SEQ ID NO: 2420 | mir-668 | SEQ ID NO: 582 | SEQ ID NO: 2503 | mir-892c | SEQ ID NO: 617 | SEQ ID NO: 2730 |
| mir-548a-2 | SEQ ID NO: 390 | SEQ ID NO: 2403 | mir-548f-1 | SEQ ID NO: 427 | SEQ ID NO: 2421 | mir-670 | SEQ ID NO: 583 | SEQ ID NO: 2504 | mir-937 | SEQ ID NO: 626 | SEQ ID NO: 2735 |
| mir-548a-3 | SEQ ID NO: 391 | SEQ ID NO: 2403 | mir-548f-2 | SEQ ID NO: 428 | SEQ ID NO: 2421 | mir-671 | SEQ ID NO: 584 | SEQ ID NO: 2506 | mir-939 | SEQ ID NO: 628 | SEQ ID NO: 2736 |
| mir-548ah | SEQ ID NO: 401 | SEQ ID NO: 2404 | mir-548f-3 | SEQ ID NO: 429 | SEQ ID NO: 2421 | mir-675 | SEQ ID NO: 585 | SEQ ID NO: 2544 | mir-942 | SEQ ID NO: 634 | SEQ ID NO: 2737 |
| mir-548aj-1 | SEQ ID NO: 403 | SEQ ID NO: 2405 | mir-548f-4 | SEQ ID NO: 430 | SEQ ID NO: 2421 | mir-676 | SEQ ID NO: 586 | SEQ ID NO: 2555 | mir-1178 | SEQ ID NO: 637 | SEQ ID NO: 1889 |
| mir-548aj-2 | SEQ ID NO: 404 | SEQ ID NO: 2405 | mir-548f-5 | SEQ ID NO: 431 | SEQ ID NO: 2421 | mir-708 | SEQ ID NO: 587 | SEQ ID NO: 2684 | mir-1180 | SEQ ID NO: 639 | SEQ ID NO: 1890 |
| mir-548am | SEQ ID NO: 407 | SEQ ID NO: 2406 | mir-548g | SEQ ID NO: 432 | SEQ ID NO: 2422 | mir-744 | SEQ ID NO: 590 | SEQ ID NO: 2706 | mir-1185-2 | SEQ ID NO: 647 | SEQ ID NO: 1891 |

| Name | Hairpin | Mature 5' | Name | Hairpin | Mature 5' | Name | Hairpin | Mature 5' | Name | Hairpin | Mature 5' |
|---|---|---|---|---|---|---|---|---|---|---|---|
| mir-758 | SEQ ID NO: 591 | SEQ ID NO: 2707 | mir-1185-1 | SEQ ID NO: 646 | SEQ ID NO: 1891 | mir-3120 | SEQ ID NO: 824 | SEQ ID NO: 2068 | mir-3160-2 | SEQ ID NO: 872 | SEQ ID NO: 2087 |
| mir-766 | SEQ ID NO: 598 | SEQ ID NO: 2709 | mir-1199 | SEQ ID NO: 650 | SEQ ID NO: 1892 | mir-3121 | SEQ ID NO: 825 | SEQ ID NO: 2069 | mir-3160-1 | SEQ ID NO: 871 | SEQ ID NO: 2087 |
| mir-767 | SEQ ID NO: 599 | SEQ ID NO: 2710 | mir-1207 | SEQ ID NO: 657 | SEQ ID NO: 1893 | mir-3124 | SEQ ID NO: 828 | SEQ ID NO: 2070 | mir-3162 | SEQ ID NO: 874 | SEQ ID NO: 2088 |
| mir-769 | SEQ ID NO: 600 | SEQ ID NO: 2711 | mir-1224 | SEQ ID NO: 659 | SEQ ID NO: 1894 | mir-3126 | SEQ ID NO: 830 | SEQ ID NO: 2071 | mir-3173 | SEQ ID NO: 884 | SEQ ID NO: 2089 |
| mir-770 | SEQ ID NO: 601 | SEQ ID NO: 2712 | mir-1225 | SEQ ID NO: 660 | SEQ ID NO: 1895 | mir-3127 | SEQ ID NO: 831 | SEQ ID NO: 2072 | mir-3177 | SEQ ID NO: 888 | SEQ ID NO: 2090 |
| mir-873 | SEQ ID NO: 603 | SEQ ID NO: 2720 | mir-1226 | SEQ ID NO: 661 | SEQ ID NO: 1897 | mir-3129 | SEQ ID NO: 833 | SEQ ID NO: 2073 | mir-3180-5 | SEQ ID NO: 897 | SEQ ID NO: 2091 |
| mir-874 | SEQ ID NO: 604 | SEQ ID NO: 2721 | mir-1227 | SEQ ID NO: 662 | SEQ ID NO: 1898 | mir-3130-2 | SEQ ID NO: 835 | SEQ ID NO: 2074 | mir-3180-4 | SEQ ID NO: 896 | SEQ ID NO: 2091 |
| mir-875 | SEQ ID NO: 605 | SEQ ID NO: 2722 | mir-1228 | SEQ ID NO: 663 | SEQ ID NO: 1899 | mir-3130-1 | SEQ ID NO: 834 | SEQ ID NO: 2074 | mir-3180-3 | SEQ ID NO: 895 | SEQ ID NO: 2091 |
| mir-876 | SEQ ID NO: 606 | SEQ ID NO: 2723 | mir-1229 | SEQ ID NO: 664 | SEQ ID NO: 1900 | mir-3136 | SEQ ID NO: 842 | SEQ ID NO: 2075 | mir-3180-2 | SEQ ID NO: 894 | SEQ ID NO: 2091 |
| mir-877 | SEQ ID NO: 607 | SEQ ID NO: 2724 | mir-1233-2 | SEQ ID NO: 667 | SEQ ID NO: 1901 | mir-3140 | SEQ ID NO: 846 | SEQ ID NO: 2076 | mir-3180-1 | SEQ ID NO: 893 | SEQ ID NO: 2091 |
| mir-885 | SEQ ID NO: 608 | SEQ ID NO: 2725 | mir-1233-1 | SEQ ID NO: 666 | SEQ ID NO: 1901 | mir-3144 | SEQ ID NO: 850 | SEQ ID NO: 2077 | mir-3184 | SEQ ID NO: 901 | SEQ ID NO: 2092 |
| mir-887 | SEQ ID NO: 609 | SEQ ID NO: 2726 | mir-1236 | SEQ ID NO: 669 | SEQ ID NO: 1902 | mir-3145 | SEQ ID NO: 851 | SEQ ID NO: 2078 | mir-3186 | SEQ ID NO: 903 | SEQ ID NO: 2093 |
| mir-888 | SEQ ID NO: 610 | SEQ ID NO: 2727 | mir-1237 | SEQ ID NO: 670 | SEQ ID NO: 1903 | mir-3150a | SEQ ID NO: 856 | SEQ ID NO: 2079 | mir-3187 | SEQ ID NO: 904 | SEQ ID NO: 2094 |
| mir-1238 | SEQ ID NO: 671 | SEQ ID NO: 1904 | mir-1304 | SEQ ID NO: 759 | SEQ ID NO: 1932 | mir-3150b | SEQ ID NO: 857 | SEQ ID NO: 2080 | mir-3189 | SEQ ID NO: 906 | SEQ ID NO: 2095 |
| mir-1245b | SEQ ID NO: 677 | SEQ ID NO: 1905 | mir-1306 | SEQ ID NO: 761 | SEQ ID NO: 1933 | mir-3151 | SEQ ID NO: 858 | SEQ ID NO: 2081 | mir-3190 | SEQ ID NO: 907 | SEQ ID NO: 2096 |
| mir-1247 | SEQ ID NO: 679 | SEQ ID NO: 1907 | mir-1307 | SEQ ID NO: 762 | SEQ ID NO: 1934 | mir-3152 | SEQ ID NO: 859 | SEQ ID NO: 2082 | mir-3191 | SEQ ID NO: 908 | SEQ ID NO: 2097 |
| mir-1250 | SEQ ID NO: 682 | SEQ ID NO: 1908 | mir-1343 | SEQ ID NO: 767 | SEQ ID NO: 1939 | mir-3156-3 | SEQ ID NO: 866 | SEQ ID NO: 2083 | mir-3192 | SEQ ID NO: 909 | SEQ ID NO: 2098 |
| mir-1251 | SEQ ID NO: 683 | SEQ ID NO: 1909 | mir-1468 | SEQ ID NO: 768 | SEQ ID NO: 1952 | mir-3156-2 | SEQ ID NO: 865 | SEQ ID NO: 2083 | mir-3194 | SEQ ID NO: 911 | SEQ ID NO: 2099 |
| mir-1252 | SEQ ID NO: 684 | SEQ ID NO: 1910 | mir-1537 | SEQ ID NO: 772 | SEQ ID NO: 1962 | mir-3156-1 | SEQ ID NO: 864 | SEQ ID NO: 2083 | mir-3200 | SEQ ID NO: 919 | SEQ ID NO: 2100 |
| mir-1255b-1 | SEQ ID NO: 689 | SEQ ID NO: 1911 | mir-1908 | SEQ ID NO: 778 | SEQ ID NO: 1981 | mir-3529 | SEQ ID NO: 923 | SEQ ID NO: 2121 | mir-3681 | SEQ ID NO: 978 | SEQ ID NO: 2148 |
| mir-1255b-2 | SEQ ID NO: 690 | SEQ ID NO: 1911 | mir-1909 | SEQ ID NO: 779 | SEQ ID NO: 1982 | mir-3591 | SEQ ID NO: 924 | SEQ ID NO: 2122 | mir-3682 | SEQ ID NO: 979 | SEQ ID NO: 2149 |
| mir-1266 | SEQ ID NO: 701 | SEQ ID NO: 1915 | mir-1910 | SEQ ID NO: 780 | SEQ ID NO: 1984 | mir-3605 | SEQ ID NO: 925 | SEQ ID NO: 2123 | mir-3688-2 | SEQ ID NO: 986 | SEQ ID NO: 2150 |
| mir-1271 | SEQ ID NO: 709 | SEQ ID NO: 1916 | mir-1911 | SEQ ID NO: 781 | SEQ ID NO: 1985 | mir-3606 | SEQ ID NO: 926 | SEQ ID NO: 2124 | mir-3688-1 | SEQ ID NO: 985 | SEQ ID NO: 2150 |
| mir-1273g | SEQ ID NO: 716 | SEQ ID NO: 1917 | mir-1914 | SEQ ID NO: 784 | SEQ ID NO: 1986 | mir-3607 | SEQ ID NO: 927 | SEQ ID NO: 2125 | mir-3689a | SEQ ID NO: 987 | SEQ ID NO: 2151 |
| mir-1273h | SEQ ID NO: 717 | SEQ ID NO: 1918 | mir-1915 | SEQ ID NO: 785 | SEQ ID NO: 1987 | mir-3613 | SEQ ID NO: 932 | SEQ ID NO: 2126 | mir-3689b | SEQ ID NO: 988 | SEQ ID NO: 2152 |
| mir-1277 | SEQ ID NO: 720 | SEQ ID NO: 1920 | mir-2114 | SEQ ID NO: 795 | SEQ ID NO: 2014 | mir-3614 | SEQ ID NO: 933 | SEQ ID NO: 2127 | mir-3691 | SEQ ID NO: 996 | SEQ ID NO: 2153 |
| mir-1285-2 | SEQ ID NO: 729 | SEQ ID NO: 1923 | mir-2115 | SEQ ID NO: 796 | SEQ ID NO: 2015 | mir-3616 | SEQ ID NO: 935 | SEQ ID NO: 2129 | mir-3692 | SEQ ID NO: 997 | SEQ ID NO: 2154 |
| mir-1285-1 | SEQ ID NO: 728 | SEQ ID NO: 1923 | mir-2116 | SEQ ID NO: 797 | SEQ ID NO: 2017 | mir-3617 | SEQ ID NO: 936 | SEQ ID NO: 2130 | mir-3912 | SEQ ID NO: 1006 | SEQ ID NO: 2175 |
| mir-1287 | SEQ ID NO: 731 | SEQ ID NO: 1924 | mir-2276 | SEQ ID NO: 799 | SEQ ID NO: 2032 | mir-3619 | SEQ ID NO: 938 | SEQ ID NO: 2131 | mir-3913-2 | SEQ ID NO: 1008 | SEQ ID NO: 2176 |
| mir-1288 | SEQ ID NO: 732 | SEQ ID NO: 1925 | mir-2277 | SEQ ID NO: 800 | SEQ ID NO: 2033 | mir-3620 | SEQ ID NO: 939 | SEQ ID NO: 2132 | mir-3913-1 | SEQ ID NO: 1007 | SEQ ID NO: 2176 |
| mir-1292 | SEQ ID NO: 737 | SEQ ID NO: 1926 | mir-2355 | SEQ ID NO: 802 | SEQ ID NO: 2034 | mir-3622a | SEQ ID NO: 941 | SEQ ID NO: 2133 | mir-3922 | SEQ ID NO: 1018 | SEQ ID NO: 2177 |
| mir-1295b | SEQ ID NO: 741 | SEQ ID NO: 1927 | mir-2467 | SEQ ID NO: 804 | SEQ ID NO: 2039 | mir-3622b | SEQ ID NO: 942 | SEQ ID NO: 2134 | mir-3925 | SEQ ID NO: 1021 | SEQ ID NO: 2178 |
| mir-1296 | SEQ ID NO: 742 | SEQ ID NO: 1929 | mir-2681 | SEQ ID NO: 805 | SEQ ID NO: 2041 | mir-3663 | SEQ ID NO: 959 | SEQ ID NO: 2139 | mir-3927 | SEQ ID NO: 1024 | SEQ ID NO: 2179 |
| mir-1298 | SEQ ID NO: 744 | SEQ ID NO: 1930 | mir-2682 | SEQ ID NO: 806 | SEQ ID NO: 2042 | mir-3664 | SEQ ID NO: 960 | SEQ ID NO: 2140 | mir-3928 | SEQ ID NO: 1025 | SEQ ID NO: 2180 |
| mir-1301 | SEQ ID NO: 746 | SEQ ID NO: 1931 | mir-3064 | SEQ ID NO: 809 | SEQ ID NO: 2059 | mir-3667 | SEQ ID NO: 963 | SEQ ID NO: 2141 | mir-3934 | SEQ ID NO: 1027 | SEQ ID NO: 2181 |
| mir-3065 | SEQ ID NO: 810 | SEQ ID NO: 2060 | mir-3157 | SEQ ID NO: 867 | SEQ ID NO: 2084 | mir-3675 | SEQ ID NO: 972 | SEQ ID NO: 2142 | mir-3940 | SEQ ID NO: 1033 | SEQ ID NO: 2182 |
| mir-3074 | SEQ ID NO: 811 | SEQ ID NO: 2061 | mir-3158-2 | SEQ ID NO: 869 | SEQ ID NO: 2085 | mir-3677 | SEQ ID NO: 973 | SEQ ID NO: 2144 | mir-3942 | SEQ ID NO: 1035 | SEQ ID NO: 2183 |
| mir-3117 | SEQ ID NO: 815 | SEQ ID NO: 2067 | mir-3158-1 | SEQ ID NO: 868 | SEQ ID NO: 2085 | mir-3678 | SEQ ID NO: 974 | SEQ ID NO: 2145 | mir-3944 | SEQ ID NO: 1037 | SEQ ID NO: 2184 |

-continued

| Name | Hairpin | Mature 5' | Name | Hairpin | Mature 5' |
|---|---|---|---|---|---|
| mir-3679 | SEQ ID NO: 975 | SEQ ID NO: 2146 | mir-4423 | SEQ ID NO: 1136 | SEQ ID NO: 2195 |
| mir-3680-2 | SEQ ID NO: 977 | SEQ ID NO: 2147 | mir-4433b | SEQ ID NO: 1147 | SEQ ID NO: 2197 |
| mir-3680-1 | SEQ ID NO: 976 | SEQ ID NO: 2147 | mir-4433 | SEQ ID NO: 1146 | SEQ ID NO: 2196 |
| mir-4436b-1 | SEQ ID NO: 1152 | SEQ ID NO: 2198 | mir-4650-1 | SEQ ID NO: 1284 | SEQ ID NO: 2224 |
| mir-4436b-2 | SEQ ID NO: 1153 | SEQ ID NO: 2198 | mir-4652 | SEQ ID NO: 1287 | SEQ ID NO: 2225 |
| mir-4445 | SEQ ID NO: 1163 | SEQ ID NO: 2199 | mir-4653 | SEQ ID NO: 1288 | SEQ ID NO: 2226 |
| mir-4446 | SEQ ID NO: 1164 | SEQ ID NO: 2200 | mir-4655 | SEQ ID NO: 1290 | SEQ ID NO: 2227 |
| mir-4474 | SEQ ID NO: 1193 | SEQ ID NO: 2201 | mir-4659a | SEQ ID NO: 1294 | SEQ ID NO: 2228 |
| mir-4482 | SEQ ID NO: 1202 | SEQ ID NO: 2202 | mir-4659b | SEQ ID NO: 1295 | SEQ ID NO: 2229 |
| mir-4520a | SEQ ID NO: 1242 | SEQ ID NO: 2207 | mir-4661 | SEQ ID NO: 1297 | SEQ ID NO: 2230 |
| mir-4520b | SEQ ID NO: 1243 | SEQ ID NO: 2208 | mir-4662a | SEQ ID NO: 1298 | SEQ ID NO: 2231 |
| mir-4524a | SEQ ID NO: 1247 | SEQ ID NO: 2209 | mir-4664 | SEQ ID NO: 1301 | SEQ ID NO: 2232 |
| mir-4524b | SEQ ID NO: 1248 | SEQ ID NO: 2210 | mir-4665 | SEQ ID NO: 1302 | SEQ ID NO: 2233 |
| mir-4529 | SEQ ID NO: 1253 | SEQ ID NO: 2212 | mir-4666a | SEQ ID NO: 1303 | SEQ ID NO: 2234 |
| mir-4536-2 | SEQ ID NO: 1261 | SEQ ID NO: 2213 | mir-4667 | SEQ ID NO: 1305 | SEQ ID NO: 2235 |
| mir-4536-1 | SEQ ID NO: 1260 | SEQ ID NO: 2213 | mir-4668 | SEQ ID NO: 1306 | SEQ ID NO: 2236 |
| mir-4632 | SEQ ID NO: 1266 | SEQ ID NO: 2216 | mir-4670 | SEQ ID NO: 1308 | SEQ ID NO: 2237 |
| mir-4633 | SEQ ID NO: 1267 | SEQ ID NO: 2217 | mir-4671 | SEQ ID NO: 1309 | SEQ ID NO: 2238 |
| mir-4638 | SEQ ID NO: 1272 | SEQ ID NO: 2218 | mir-4676 | SEQ ID NO: 1314 | SEQ ID NO: 2239 |
| mir-4639 | SEQ ID NO: 1273 | SEQ ID NO: 2219 | mir-4677 | SEQ ID NO: 1315 | SEQ ID NO: 2240 |
| mir-4640 | SEQ ID NO: 1274 | SEQ ID NO: 2220 | mir-4680 | SEQ ID NO: 1319 | SEQ ID NO: 2241 |
| mir-4645 | SEQ ID NO: 1279 | SEQ ID NO: 2221 | mir-4684 | SEQ ID NO: 1323 | SEQ ID NO: 2242 |
| mir-4646 | SEQ ID NO: 1280 | SEQ ID NO: 2222 | mir-4685 | SEQ ID NO: 1324 | SEQ ID NO: 2243 |
| mir-4649 | SEQ ID NO: 1283 | SEQ ID NO: 2223 | mir-4687 | SEQ ID NO: 1326 | SEQ ID NO: 2244 |
| mir-4650-2 | SEQ ID NO: 1285 | SEQ ID NO: 2224 | mir-4690 | SEQ ID NO: 1329 | SEQ ID NO: 2245 |
| mir-4691 | SEQ ID NO: 1330 | SEQ ID NO: 2246 | mir-4723 | SEQ ID NO: 1361 | SEQ ID NO: 2268 |
| mir-4693 | SEQ ID NO: 1332 | SEQ ID NO: 2247 | mir-4724 | SEQ ID NO: 1362 | SEQ ID NO: 2269 |
| mir-4694 | SEQ ID NO: 1333 | SEQ ID NO: 2248 | mir-4725 | SEQ ID NO: 1363 | SEQ ID NO: 2270 |
| mir-4695 | SEQ ID NO: 1334 | SEQ ID NO: 2249 | mir-4726 | SEQ ID NO: 1364 | SEQ ID NO: 2271 |
| mir-4697 | SEQ ID NO: 1336 | SEQ ID NO: 2250 | mir-4727 | SEQ ID NO: 1365 | SEQ ID NO: 2272 |
| mir-4699 | SEQ ID NO: 1338 | SEQ ID NO: 2251 | mir-4728 | SEQ ID NO: 1366 | SEQ ID NO: 2273 |
| mir-4700 | SEQ ID NO: 1339 | SEQ ID NO: 2252 | mir-4731 | SEQ ID NO: 1369 | SEQ ID NO: 2274 |
| mir-4701 | SEQ ID NO: 1340 | SEQ ID NO: 2253 | mir-4732 | SEQ ID NO: 1370 | SEQ ID NO: 2275 |
| mir-4703 | SEQ ID NO: 1341 | SEQ ID NO: 2254 | mir-4733 | SEQ ID NO: 1371 | SEQ ID NO: 2276 |
| mir-4704 | SEQ ID NO: 1342 | SEQ ID NO: 2255 | mir-4735 | SEQ ID NO: 1373 | SEQ ID NO: 2277 |
| mir-4707 | SEQ ID NO: 1345 | SEQ ID NO: 2256 | mir-4738 | SEQ ID NO: 1376 | SEQ ID NO: 2278 |
| mir-4708 | SEQ ID NO: 1346 | SEQ ID NO: 2257 | mir-4740 | SEQ ID NO: 1378 | SEQ ID NO: 2279 |
| mir-4709 | SEQ ID NO: 1347 | SEQ ID NO: 2258 | mir-4742 | SEQ ID NO: 1380 | SEQ ID NO: 2280 |

-continued

| Name | Hairpin | Mature 5' | Name | Hairpin | Mature 5' |
|---|---|---|---|---|---|
| mir-4711 | SEQ ID NO: 1349 | SEQ ID NO: 2259 | mir-4743 | SEQ ID NO: 1381 | SEQ ID NO: 2281 |
| mir-4712 | SEQ ID NO: 1350 | SEQ ID NO: 2260 | mir-4745 | SEQ ID NO: 1383 | SEQ ID NO: 2282 |
| mir-4713 | SEQ ID NO: 1351 | SEQ ID NO: 2261 | mir-4746 | SEQ ID NO: 1384 | SEQ ID NO: 2283 |
| mir-4714 | SEQ ID NO: 1352 | SEQ ID NO: 2262 | mir-4747 | SEQ ID NO: 1385 | SEQ ID NO: 2284 |
| mir-4715 | SEQ ID NO: 1353 | SEQ ID NO: 2263 | mir-4749 | SEQ ID NO: 1387 | SEQ ID NO: 2285 |
| mir-4716 | SEQ ID NO: 1354 | SEQ ID NO: 2264 | mir-4750 | SEQ ID NO: 1388 | SEQ ID NO: 2286 |
| mir-4717 | SEQ ID NO: 1355 | SEQ ID NO: 2265 | mir-4753 | SEQ ID NO: 1391 | SEQ ID NO: 2287 |
| mir-4720 | SEQ ID NO: 1358 | SEQ ID NO: 2266 | mir-4755 | SEQ ID NO: 1393 | SEQ ID NO: 2288 |
| mir-4722 | SEQ ID NO: 1360 | SEQ ID NO: 2267 | mir-4756 | SEQ ID NO: 1394 | SEQ ID NO: 2289 |
| mir-4757 | SEQ ID NO: 1395 | SEQ ID NO: 2290 | mir-4790 | SEQ ID NO: 1431 | SEQ ID NO: 2311 |
| mir-4758 | SEQ ID NO: 1396 | SEQ ID NO: 2291 | mir-4793 | SEQ ID NO: 1434 | SEQ ID NO: 2312 |
| mir-4760 | SEQ ID NO: 1398 | SEQ ID NO: 2292 | mir-4795 | SEQ ID NO: 1436 | SEQ ID NO: 2313 |
| mir-4761 | SEQ ID NO: 1399 | SEQ ID NO: 2293 | mir-4796 | SEQ ID NO: 1437 | SEQ ID NO: 2314 |
| mir-4762 | SEQ ID NO: 1400 | SEQ ID NO: 2294 | mir-4797 | SEQ ID NO: 1438 | SEQ ID NO: 2315 |
| mir-4763 | SEQ ID NO: 1401 | SEQ ID NO: 2295 | mir-4798 | SEQ ID NO: 1439 | SEQ ID NO: 2316 |
| mir-4764 | SEQ ID NO: 1402 | SEQ ID NO: 2296 | mir-4799 | SEQ ID NO: 1440 | SEQ ID NO: 2317 |
| mir-4766 | SEQ ID NO: 1404 | SEQ ID NO: 2297 | mir-4800 | SEQ ID NO: 1441 | SEQ ID NO: 2318 |
| mir-4768 | SEQ ID NO: 1406 | SEQ ID NO: 2298 | mir-4802 | SEQ ID NO: 1443 | SEQ ID NO: 2319 |
| mir-4769 | SEQ ID NO: 1407 | SEQ ID NO: 2299 | mir-4804 | SEQ ID NO: 1445 | SEQ ID NO: 2320 |
| mir-4772 | SEQ ID NO: 1411 | SEQ ID NO: 2300 | mir-4999 | SEQ ID NO: 1446 | SEQ ID NO: 2334 |
| mir-4774 | SEQ ID NO: 1414 | SEQ ID NO: 2301 | mir-5000 | SEQ ID NO: 1447 | SEQ ID NO: 2337 |
| mir-4776-2 | SEQ ID NO: 1417 | SEQ ID NO: 2302 | mir-5001 | SEQ ID NO: 1448 | SEQ ID NO: 2338 |
| mir-4776-1 | SEQ ID NO: 1416 | SEQ ID NO: 2302 | mir-5002 | SEQ ID NO: 1449 | SEQ ID NO: 2339 |
| mir-4777 | SEQ ID NO: 1418 | SEQ ID NO: 2303 | mir-5003 | SEQ ID NO: 1450 | SEQ ID NO: 2340 |
| mir-4778 | SEQ ID NO: 1419 | SEQ ID NO: 2304 | mir-5004 | SEQ ID NO: 1451 | SEQ ID NO: 2341 |
| mir-4781 | SEQ ID NO: 1422 | SEQ ID NO: 2305 | mir-5006 | SEQ ID NO: 1452 | SEQ ID NO: 2342 |
| mir-4782 | SEQ ID NO: 1423 | SEQ ID NO: 2306 | mir-5007 | SEQ ID NO: 1453 | SEQ ID NO: 2343 |
| mir-4783 | SEQ ID NO: 1424 | SEQ ID NO: 2307 | mir-5008 | SEQ ID NO: 1454 | SEQ ID NO: 2344 |
| mir-4786 | SEQ ID NO: 1427 | SEQ ID NO: 2308 | mir-5009 | SEQ ID NO: 1455 | SEQ ID NO: 2345 |
| mir-4787 | SEQ ID NO: 1428 | SEQ ID NO: 2309 | mir-5010 | SEQ ID NO: 1456 | SEQ ID NO: 2348 |
| mir-4789 | SEQ ID NO: 1430 | SEQ ID NO: 2310 | mir-5011 | SEQ ID NO: 1457 | SEQ ID NO: 2349 |
| mir-5088 | SEQ ID NO: 1460 | SEQ ID NO: 2357 | mir-5699 | SEQ ID NO: 1521 | SEQ ID NO: 2449 |
| mir-5089 | SEQ ID NO: 1461 | SEQ ID NO: 2358 | mir-6499 | SEQ ID NO: 1571 | SEQ ID NO: 2474 |
| mir-5187 | SEQ ID NO: 1471 | SEQ ID NO: 2373 | mir-6500 | SEQ ID NO: 1572 | SEQ ID NO: 2475 |
| mir-5189 | SEQ ID NO: 1473 | SEQ ID NO: 2374 | mir-6501 | SEQ ID NO: 1573 | SEQ ID NO: 2476 |
| mir-5195 | SEQ ID NO: 1479 | SEQ ID NO: 2380 | mir-6502 | SEQ ID NO: 1574 | SEQ ID NO: 2477 |
| mir-5196 | SEQ ID NO: 1480 | SEQ ID NO: 2381 | mir-6503 | SEQ ID NO: 1575 | SEQ ID NO: 2478 |
| mir-5197 | SEQ ID NO: 1481 | SEQ ID NO: 2382 | mir-6504 | SEQ ID NO: 1576 | SEQ ID NO: 2479 |

| Name | Hairpin | Mature 5' | Name | Hairpin | Mature 5' | Name | Hairpin | Mature 5' | Name | Hairpin | Mature 5' |
|---|---|---|---|---|---|---|---|---|---|---|---|
| mir-5571 | SEQ ID NO: 1482 | SEQ ID NO: 2434 | mir-6505 | SEQ ID NO: 1577 | SEQ ID NO: 2480 | mir-6761 | SEQ ID NO: 1640 | SEQ ID NO: 2550 | mir-6780a | SEQ ID NO: 1662 | SEQ ID NO: 2571 |
| mir-5579 | SEQ ID NO: 1484 | SEQ ID NO: 2435 | mir-6506 | SEQ ID NO: 1578 | SEQ ID NO: 2481 | mir-6762 | SEQ ID NO: 1641 | SEQ ID NO: 2551 | mir-6780b | SEQ ID NO: 1663 | SEQ ID NO: 2572 |
| mir-5580 | SEQ ID NO: 1485 | SEQ ID NO: 2436 | mir-6507 | SEQ ID NO: 1579 | SEQ ID NO: 2482 | mir-6763 | SEQ ID NO: 1642 | SEQ ID NO: 2552 | mir-6781 | SEQ ID NO: 1664 | SEQ ID NO: 2573 |
| mir-5581 | SEQ ID NO: 1486 | SEQ ID NO: 2437 | mir-6508 | SEQ ID NO: 1580 | SEQ ID NO: 2483 | mir-6764 | SEQ ID NO: 1643 | SEQ ID NO: 2553 | mir-6782 | SEQ ID NO: 1665 | SEQ ID NO: 2574 |
| mir-5582 | SEQ ID NO: 1487 | SEQ ID NO: 2438 | mir-6509 | SEQ ID NO: 1581 | SEQ ID NO: 2484 | mir-6765 | SEQ ID NO: 1644 | SEQ ID NO: 2554 | mir-6783 | SEQ ID NO: 1666 | SEQ ID NO: 2575 |
| mir-5583-2 | SEQ ID NO: 1489 | SEQ ID NO: 2439 | mir-6510 | SEQ ID NO: 1582 | SEQ ID NO: 2485 | mir-6766 | SEQ ID NO: 1645 | SEQ ID NO: 2556 | mir-6784 | SEQ ID NO: 1667 | SEQ ID NO: 2576 |
| mir-5583-1 | SEQ ID NO: 1488 | SEQ ID NO: 2439 | mir-6511a-1 | SEQ ID NO: 1583 | SEQ ID NO: 2486 | mir-6767 | SEQ ID NO: 1646 | SEQ ID NO: 2557 | mir-6785 | SEQ ID NO: 1668 | SEQ ID NO: 2577 |
| mir-5584 | SEQ ID NO: 1490 | SEQ ID NO: 2440 | mir-6511a-2 | SEQ ID NO: 1584 | SEQ ID NO: 2486 | mir-6768 | SEQ ID NO: 1647 | SEQ ID NO: 2558 | mir-6786 | SEQ ID NO: 1669 | SEQ ID NO: 2578 |
| mir-5585 | SEQ ID NO: 1491 | SEQ ID NO: 2441 | mir-6511a-3 | SEQ ID NO: 1585 | SEQ ID NO: 2486 | mir-6769a | SEQ ID NO: 1648 | SEQ ID NO: 2559 | mir-6787 | SEQ ID NO: 1670 | SEQ ID NO: 2579 |
| mir-5586 | SEQ ID NO: 1492 | SEQ ID NO: 2442 | mir-6511a-4 | SEQ ID NO: 1586 | SEQ ID NO: 2486 | mir-6769b | SEQ ID NO: 1649 | SEQ ID NO: 2560 | mir-6788 | SEQ ID NO: 1671 | SEQ ID NO: 2580 |
| mir-5587 | SEQ ID NO: 1493 | SEQ ID NO: 2443 | mir-6511b-1 | SEQ ID NO: 1587 | SEQ ID NO: 2487 | mir-6770-3 | SEQ ID NO: 1652 | SEQ ID NO: 2561 | mir-6789 | SEQ ID NO: 1672 | SEQ ID NO: 2581 |
| mir-5588 | SEQ ID NO: 1494 | SEQ ID NO: 2444 | mir-6511b-2 | SEQ ID NO: 1588 | SEQ ID NO: 2487 | mir-6770-2 | SEQ ID NO: 1651 | SEQ ID NO: 2561 | mir-6790 | SEQ ID NO: 1673 | SEQ ID NO: 2582 |
| mir-5589 | SEQ ID NO: 1495 | SEQ ID NO: 2445 | mir-6512 | SEQ ID NO: 1589 | SEQ ID NO: 2488 | mir-6770-1 | SEQ ID NO: 1650 | SEQ ID NO: 2561 | mir-6791 | SEQ ID NO: 1674 | SEQ ID NO: 2583 |
| mir-5590 | SEQ ID NO: 1496 | SEQ ID NO: 2446 | mir-6513 | SEQ ID NO: 1590 | SEQ ID NO: 2489 | mir-6771 | SEQ ID NO: 1653 | SEQ ID NO: 2562 | mir-6792 | SEQ ID NO: 1675 | SEQ ID NO: 2584 |
| mir-5591 | SEQ ID NO: 1497 | SEQ ID NO: 2447 | mir-6514 | SEQ ID NO: 1591 | SEQ ID NO: 2490 | mir-6772 | SEQ ID NO: 1654 | SEQ ID NO: 2563 | mir-6793 | SEQ ID NO: 1676 | SEQ ID NO: 2585 |
| mir-6515 | SEQ ID NO: 1592 | SEQ ID NO: 2491 | mir-6737 | SEQ ID NO: 1616 | SEQ ID NO: 2526 | mir-6773 | SEQ ID NO: 1655 | SEQ ID NO: 2564 | mir-6794 | SEQ ID NO: 1677 | SEQ ID NO: 2586 |
| mir-6516 | SEQ ID NO: 1593 | SEQ ID NO: 2493 | mir-6738 | SEQ ID NO: 1617 | SEQ ID NO: 2527 | mir-6774 | SEQ ID NO: 1656 | SEQ ID NO: 2565 | mir-6795 | SEQ ID NO: 1678 | SEQ ID NO: 2587 |
| mir-6715b | SEQ ID NO: 1595 | SEQ ID NO: 2505 | mir-6739 | SEQ ID NO: 1618 | SEQ ID NO: 2528 | mir-6775 | SEQ ID NO: 1657 | SEQ ID NO: 2566 | mir-6796 | SEQ ID NO: 1679 | SEQ ID NO: 2588 |
| mir-6716 | SEQ ID NO: 1596 | SEQ ID NO: 2507 | mir-6740 | SEQ ID NO: 1619 | SEQ ID NO: 2529 | mir-6776 | SEQ ID NO: 1658 | SEQ ID NO: 2567 | mir-6797 | SEQ ID NO: 1680 | SEQ ID NO: 2589 |
| mir-6717 | SEQ ID NO: 1597 | SEQ ID NO: 2508 | mir-6741 | SEQ ID NO: 1620 | SEQ ID NO: 2530 | mir-6777 | SEQ ID NO: 1659 | SEQ ID NO: 2568 | mir-6798 | SEQ ID NO: 1681 | SEQ ID NO: 2590 |
| mir-6718 | SEQ ID NO: 1598 | SEQ ID NO: 2509 | mir-6742 | SEQ ID NO: 1621 | SEQ ID NO: 2531 | mir-6778 | SEQ ID NO: 1660 | SEQ ID NO: 2569 | mir-6799 | SEQ ID NO: 1682 | SEQ ID NO: 2591 |
| mir-6720 | SEQ ID NO: 1600 | SEQ ID NO: 2510 | mir-6743 | SEQ ID NO: 1622 | SEQ ID NO: 2532 | mir-6800 | SEQ ID NO: 1683 | SEQ ID NO: 2592 | mir-6822 | SEQ ID NO: 1705 | SEQ ID NO: 2614 |
| mir-6721 | SEQ ID NO: 1601 | SEQ ID NO: 2511 | mir-6744 | SEQ ID NO: 1623 | SEQ ID NO: 2533 | mir-6801 | SEQ ID NO: 1684 | SEQ ID NO: 2593 | mir-6823 | SEQ ID NO: 1706 | SEQ ID NO: 2615 |
| mir-6722 | SEQ ID NO: 1602 | SEQ ID NO: 2512 | mir-6746 | SEQ ID NO: 1625 | SEQ ID NO: 2534 | mir-6802 | SEQ ID NO: 1685 | SEQ ID NO: 2594 | mir-6824 | SEQ ID NO: 1707 | SEQ ID NO: 2616 |
| mir-6723 | SEQ ID NO: 1603 | SEQ ID NO: 2513 | mir-6747 | SEQ ID NO: 1626 | SEQ ID NO: 2535 | mir-6803 | SEQ ID NO: 1686 | SEQ ID NO: 2595 | mir-6825 | SEQ ID NO: 1708 | SEQ ID NO: 2617 |
| mir-6724 | SEQ ID NO: 1604 | SEQ ID NO: 2514 | mir-6748 | SEQ ID NO: 1627 | SEQ ID NO: 2536 | mir-6804 | SEQ ID NO: 1687 | SEQ ID NO: 2596 | mir-6826 | SEQ ID NO: 1709 | SEQ ID NO: 2618 |
| mir-6726 | SEQ ID NO: 1605 | SEQ ID NO: 2515 | mir-6749 | SEQ ID NO: 1628 | SEQ ID NO: 2537 | mir-6805 | SEQ ID NO: 1688 | SEQ ID NO: 2597 | mir-6827 | SEQ ID NO: 1710 | SEQ ID NO: 2619 |
| mir-6727 | SEQ ID NO: 1606 | SEQ ID NO: 2516 | mir-6750 | SEQ ID NO: 1629 | SEQ ID NO: 2538 | mir-6806 | SEQ ID NO: 1689 | SEQ ID NO: 2598 | mir-6828 | SEQ ID NO: 1711 | SEQ ID NO: 2620 |
| mir-6728 | SEQ ID NO: 1607 | SEQ ID NO: 2517 | mir-6751 | SEQ ID NO: 1630 | SEQ ID NO: 2539 | mir-6807 | SEQ ID NO: 1690 | SEQ ID NO: 2599 | mir-6829 | SEQ ID NO: 1712 | SEQ ID NO: 2621 |
| mir-6729 | SEQ ID NO: 1608 | SEQ ID NO: 2518 | mir-6752 | SEQ ID NO: 1631 | SEQ ID NO: 2540 | mir-6808 | SEQ ID NO: 1691 | SEQ ID NO: 2600 | mir-6830 | SEQ ID NO: 1713 | SEQ ID NO: 2622 |
| mir-6730 | SEQ ID NO: 1609 | SEQ ID NO: 2519 | mir-6753 | SEQ ID NO: 1632 | SEQ ID NO: 2541 | mir-6809 | SEQ ID NO: 1692 | SEQ ID NO: 2601 | mir-6831 | SEQ ID NO: 1714 | SEQ ID NO: 2623 |
| mir-6731 | SEQ ID NO: 1610 | SEQ ID NO: 2520 | mir-6754 | SEQ ID NO: 1633 | SEQ ID NO: 2542 | mir-6810 | SEQ ID NO: 1693 | SEQ ID NO: 2602 | mir-6832 | SEQ ID NO: 1715 | SEQ ID NO: 2624 |
| mir-6732 | SEQ ID NO: 1611 | SEQ ID NO: 2521 | mir-6755 | SEQ ID NO: 1634 | SEQ ID NO: 2543 | mir-6811 | SEQ ID NO: 1694 | SEQ ID NO: 2603 | mir-6833 | SEQ ID NO: 1716 | SEQ ID NO: 2625 |
| mir-6733 | SEQ ID NO: 1612 | SEQ ID NO: 2522 | mir-6756 | SEQ ID NO: 1635 | SEQ ID NO: 2545 | mir-6812 | SEQ ID NO: 1695 | SEQ ID NO: 2604 | mir-6834 | SEQ ID NO: 1717 | SEQ ID NO: 2626 |
| mir-6734 | SEQ ID NO: 1613 | SEQ ID NO: 2523 | mir-6757 | SEQ ID NO: 1636 | SEQ ID NO: 2546 | mir-6813 | SEQ ID NO: 1696 | SEQ ID NO: 2605 | mir-6835 | SEQ ID NO: 1718 | SEQ ID NO: 2627 |
| mir-6735 | SEQ ID NO: 1614 | SEQ ID NO: 2524 | mir-6758 | SEQ ID NO: 1637 | SEQ ID NO: 2547 | mir-6814 | SEQ ID NO: 1697 | SEQ ID NO: 2606 | mir-6836 | SEQ ID NO: 1719 | SEQ ID NO: 2628 |
| mir-6736 | SEQ ID NO: 1615 | SEQ ID NO: 2525 | mir-6759 | SEQ ID NO: 1638 | SEQ ID NO: 2548 | mir-6815 | SEQ ID NO: 1698 | SEQ ID NO: 2607 | mir-6837 | SEQ ID NO: 1720 | SEQ ID NO: 2629 |
| mir-6760 | SEQ ID NO: 1639 | SEQ ID NO: 2549 | mir-6779 | SEQ ID NO: 1661 | SEQ ID NO: 2570 | mir-6816 | SEQ ID NO: 1699 | SEQ ID NO: 2608 | mir-6838 | SEQ ID NO: 1721 | SEQ ID NO: 2630 |

| Name | Hairpin | Mature 5' | Name | Hairpin | Mature 5' |
|---|---|---|---|---|---|
| mir-6817 | SEQ ID NO: 1700 | SEQ ID NO: 2609 | mir-6839 | SEQ ID NO: 1722 | SEQ ID NO: 2631 |
| mir-6818 | SEQ ID NO: 1701 | SEQ ID NO: 2610 | mir-6840 | SEQ ID NO: 1723 | SEQ ID NO: 2632 |
| mir-6819 | SEQ ID NO: 1702 | SEQ ID NO: 2611 | mir-6841 | SEQ ID NO: 1724 | SEQ ID NO: 2633 |
| mir-6820 | SEQ ID NO: 1703 | SEQ ID NO: 2612 | mir-6842 | SEQ ID NO: 1725 | SEQ ID NO: 2634 |
| mir-6821 | SEQ ID NO: 1704 | SEQ ID NO: 2613 | mir-6845 | SEQ ID NO: 1728 | SEQ ID NO: 2635 |
| mir-6846 | SEQ ID NO: 1729 | SEQ ID NO: 2636 | mir-6867 | SEQ ID NO: 1753 | SEQ ID NO: 2655 |
| mir-6847 | SEQ ID NO: 1730 | SEQ ID NO: 2637 | mir-6868 | SEQ ID NO: 1754 | SEQ ID NO: 2656 |
| mir-6848 | SEQ ID NO: 1731 | SEQ ID NO: 2638 | mir-6869 | SEQ ID NO: 1755 | SEQ ID NO: 2657 |
| mir-6849 | SEQ ID NO: 1732 | SEQ ID NO: 2639 | mir-6870 | SEQ ID NO: 1756 | SEQ ID NO: 2658 |
| mir-6850 | SEQ ID NO: 1733 | SEQ ID NO: 2640 | mir-6871 | SEQ ID NO: 1757 | SEQ ID NO: 2659 |
| mir-6851 | SEQ ID NO: 1734 | SEQ ID NO: 2641 | mir-6872 | SEQ ID NO: 1758 | SEQ ID NO: 2660 |
| mir-6852 | SEQ ID NO: 1735 | SEQ ID NO: 2642 | mir-6873 | SEQ ID NO: 1759 | SEQ ID NO: 2661 |
| mir-6853 | SEQ ID NO: 1736 | SEQ ID NO: 2643 | mir-6874 | SEQ ID NO: 1760 | SEQ ID NO: 2662 |
| mir-6854 | SEQ ID NO: 1737 | SEQ ID NO: 2644 | mir-6875 | SEQ ID NO: 1761 | SEQ ID NO: 2663 |
| mir-6855 | SEQ ID NO: 1738 | SEQ ID NO: 2645 | mir-6876 | SEQ ID NO: 1762 | SEQ ID NO: 2664 |
| mir-6856 | SEQ ID NO: 1739 | SEQ ID NO: 2646 | mir-6877 | SEQ ID NO: 1763 | SEQ ID NO: 2665 |
| mir-6857 | SEQ ID NO: 1740 | SEQ ID NO: 2647 | mir-6878 | SEQ ID NO: 1764 | SEQ ID NO: 2666 |
| mir-6858 | SEQ ID NO: 1741 | SEQ ID NO: 2648 | mir-6879 | SEQ ID NO: 1765 | SEQ ID NO: 2667 |
| mir-6859-3 | SEQ ID NO: 1744 | SEQ ID NO: 2649 | mir-6880 | SEQ ID NO: 1766 | SEQ ID NO: 2668 |
| mir-6859-2 | SEQ ID NO: 1743 | SEQ ID NO: 2649 | mir-6881 | SEQ ID NO: 1767 | SEQ ID NO: 2669 |
| mir-6859-1 | SEQ ID NO: 1742 | SEQ ID NO: 2649 | mir-6882 | SEQ ID NO: 1768 | SEQ ID NO: 2670 |
| mir-6861 | SEQ ID NO: 1746 | SEQ ID NO: 2650 | mir-6883 | SEQ ID NO: 1769 | SEQ ID NO: 2671 |
| mir-6862-2 | SEQ ID NO: 1748 | SEQ ID NO: 2651 | mir-6884 | SEQ ID NO: 1770 | SEQ ID NO: 2672 |
| mir-6862-1 | SEQ ID NO: 1747 | SEQ ID NO: 2651 | mir-6885 | SEQ ID NO: 1771 | SEQ ID NO: 2673 |
| mir-6864 | SEQ ID NO: 1750 | SEQ ID NO: 2652 | mir-6886 | SEQ ID NO: 1772 | SEQ ID NO: 2674 |
| mir-6865 | SEQ ID NO: 1751 | SEQ ID NO: 2653 | mir-6887 | SEQ ID NO: 1773 | SEQ ID NO: 2675 |
| mir-6866 | SEQ ID NO: 1752 | SEQ ID NO: 2654 | mir-6888 | SEQ ID NO: 1774 | SEQ ID NO: 2676 |
| mir-6889 | SEQ ID NO: 1775 | SEQ ID NO: 2677 | mir-7152 | SEQ ID NO: 1794 | SEQ ID NO: 2695 |
| mir-6890 | SEQ ID NO: 1776 | SEQ ID NO: 2678 | mir-7153 | SEQ ID NO: 1795 | SEQ ID NO: 2696 |
| mir-6891 | SEQ ID NO: 1777 | SEQ ID NO: 2679 | mir-7154 | SEQ ID NO: 1796 | SEQ ID NO: 2697 |
| mir-6892 | SEQ ID NO: 1778 | SEQ ID NO: 2680 | mir-7155 | SEQ ID NO: 1797 | SEQ ID NO: 2698 |
| mir-6893 | SEQ ID NO: 1779 | SEQ ID NO: 2681 | mir-7156 | SEQ ID NO: 1798 | SEQ ID NO: 2699 |
| mir-6894 | SEQ ID NO: 1780 | SEQ ID NO: 2682 | mir-7157 | SEQ ID NO: 1799 | SEQ ID NO: 2700 |
| mir-6895 | SEQ ID NO: 1781 | SEQ ID NO: 2683 | mir-7158 | SEQ ID NO: 1800 | SEQ ID NO: 2701 |
| mir-7106 | SEQ ID NO: 1782 | SEQ ID NO: 2685 | mir-7159 | SEQ ID NO: 1801 | SEQ ID NO: 2702 |
| mir-7107 | SEQ ID NO: 1783 | SEQ ID NO: 2686 | mir-7160 | SEQ ID NO: 1802 | SEQ ID NO: 2703 |
| mir-7108 | SEQ ID NO: 1784 | SEQ ID NO: 2687 | mir-7161 | SEQ ID NO: 1803 | SEQ ID NO: 2704 |
| mir-7109 | SEQ ID NO: 1785 | SEQ ID NO: 2688 | mir-7162 | SEQ ID NO: 1804 | SEQ ID NO: 2705 |
| mir-7110 | SEQ ID NO: 1786 | SEQ ID NO: 2689 | mir-7843 | SEQ ID NO: 1813 | SEQ ID NO: 2713 |
| mir-7111 | SEQ ID NO: 1787 | SEQ ID NO: 2690 | mir-7844 | SEQ ID NO: 1814 | SEQ ID NO: 2714 |
| mir-7112-2 | SEQ ID NO: 1789 | SEQ ID NO: 2691 | mir-7845 | SEQ ID NO: 1815 | SEQ ID NO: 2715 |
| mir-7112-1 | SEQ ID NO: 1788 | SEQ ID NO: 2691 | mir-7850 | SEQ ID NO: 1820 | SEQ ID NO: 2716 |
| mir-7113 | SEQ ID NO: 1790 | SEQ ID NO: 2692 | mir-7853 | SEQ ID NO: 1823 | SEQ ID NO: 2717 |
| mir-7114 | SEQ ID NO: 1791 | SEQ ID NO: 2693 | mir-7855 | SEQ ID NO: 1825 | SEQ ID NO: 2718 |
| mir-7151 | SEQ ID NO: 1793 | SEQ ID NO: 2694 | mir-7856 | SEQ ID NO: 1826 | SEQ ID NO: 2719 |

As noted, the preceding table is based on the 5' sequence of the particular RNA. If the '3 prime sequence is used to calculate the Drosha cutting site, overhang positions should be accounted for. For example, if the 3' sequence has one nucleotide overhang, positions 5 and 9-12 would correspond to positions 6 and 10-13. If the 3' sequence has two nucleotide overhangs, positions 5 and 9-12 would correspond to positions 7 and 11-14. If the 3' sequence has three nucleotide overhangs, positions 5 and 9-12 would correspond to 8 and 12-15.

Counting to define the Drosha cutting site can also be based on an in silico folding of the miRNA stem loop sequence, such as minimum free energy folding. In these examples, counting can be started by assigning position 1 to the first nucleotide on the 5' strand by the Drosha cutting site in the pre-miRNA portion of the pri-miRNA. Then position numbers can be further assigned along the hairpin moving towards the terminal loop and taking note if the nucleotides are mismatched or matched. In cases where there is an asymmetric mismatch, i.e. one strand contains more nucleotides than the other in a mismatch position, position can be assigned based on the shorter strand. If the asymmetric mismatch has a conformation where one strand contains no mismatched nucleotides, but the other strand does, then the mismatch can be assigned to the higher position. In cases where an assymetric mismatch is located at position 1, the positions can be assigned according to the 5' strand until a matched position is encountered.

FIG. 17 provides examples of counting based on the description in the preceding paragraph. In these examples, the upper sequences contain part of the pri-miRNA sequence, consisting of the pre-miRNA portion and part of the flanking sequence. Below the sequence the folded hairpin is depicted where the upper left part of each figure marks the 5' end of the sequence, and the lower left part of each figure marks the 3' end of the RNA sequence. Mature sequence and its complementary sequence (i.e. the RNA that remains after Drosha and Dicer cleavage) is marked in bold. Positions where mismatches can be removed or inserted to alter sensitivity to changing Drosha levels are underline.

Positions 5 and/or 9-12 can also be determined based on distance from the Drosha cutting site. For example, 65 angstroms is equal to 25 base pairs (bp) of RNA in a helical (paired) form, or ~2.6 angstrom per by RNA. If physical distance in angstroms from a Drosha cutting site is measured along a line following the center of the RNA helix, along the minimum linear path of the shorter strand, the predicted cutting site (Dcp)=0, and the Drosha cutting site (Dc)=0+e, where e is a continuous random variable between +/−7.8a, nucleotide positions would be: (pos. 5 nt)=Dc+(2.6)*5a+r(5)

angstroms, (pos. 9 nt)=Dc+(2.6)*9+r(9) angstroms, . . . (pos. 12 nt)=Dc+(2.6)*12a+r(12) angstroms, where r(x) is the iterative sum of x instances of a continuous random variable between +/−2.6 angstroms divided by the quantity x. If predictions of RNA secondary structure differ from measured structures, position in nucleotide and physical notation should be related as defined. Where multiple subspecies of stable secondary and tertiary structures result from a single sequence of RNA, the relation of position (nt) and physical distance should be calculated for each predicted (or measured) conformation, and modifications applied to either consensus structures, individual structures, or both.

The effects of Drosha expression on RNA based on the number of mis-matches described herein are relative. For example, an RNA with no mis-matches in positions 5 and 9-12 from the Drosha cutting site is least affected by reduced Drosha expression when compared to mRNA with 1, 2, 3, 4 or 5 mis-matches in these positions. RNA with no mis-matches in positions 5 and 9-12 are referred to as "rigid RNAs" herein. Similarly, an RNA with 1 mis-match in positions 5 and 9-12 from the Drosha cutting site is less affected by reduced Drosha expression when compared to mRNA with 2, 3, 4 or 5 mis-matches in these positions. RNA with 1 mis-match in positions 5 and 9-12 are referred to as "semi-rigid RNAs" herein. An RNA with 2 mis-matches in positions 5 and 9-12 from the Drosha cutting site is less affected by reduced Drosha expression when compared to mRNA with 3, 4 or 5 mis-matches in these positions. RNA with 2 mis-match in positions 5 and 9-12 are referred to as "quasi-rigid RNAs" herein. An RNA with 3 mis-matches in positions 5 and 9-12 from the Drosha cutting site is less affected by reduced Drosha expression when compared to mRNA with 4 or 5 mis-matches in these positions. RNA with 3 mis-match in positions 5 and 9-12 are referred to as "mis-matched RNAs" herein. An RNA with 4 mis-matches in positions 5 and 9-12 from the Drosha cutting site is less affected by reduced Drosha expression when compared to mRNA with 5 mis-matches in these positions. RNA with 4 mis-matches in positions 5 and 9-12 are referred to as "highly mis-matched RNAs" herein. An RNA with 5 mis-matches in positions 5 and 9-12 from the Drosha cutting site is most affected by reduced Drosha expression when compared to mRNA with fewer than 5 mis-matches in these positions. RNA with 5 mis-matches in positions 5 and 9-12 are referred to as "fully mis-matched RNAs" herein. Based on the foregoing, low Drosha expression leads to a higher relative percentage of rigid RNAs, followed by semi-rigid RNAs, followed by quasi-rigid RNAs, followed by mis-matched RNAs, followed by highly mis-matched RNAs with the lowest relative percentage of fully-mismatched RNAs. High Drosha expression leads to more equal expression of all RNA types. As used herein, and for convenience only based on the relative nature of the described effects, "unaffected RNAs" can generally include rigid, semi-rigid and quasi-rigid RNAs whereas "affected RNAs" can generally include mis-matched, highly mis-matched and fully-mismatched RNAs.

One of ordinary skill in the art can readily determine whether an RNA is rigid, semi-rigid, quasi-rigid, mis-matched, highly mis-matched or fully mis-matched by referencing available texts and databases.

Exemplary rigid miRNAs include: let7b; let7d; let7f; let7i; miR-1; miR-101; miR-103; miR-105; miR-106a; miR-10a; miR-10b; miR-126*; miR-127; miR-137; miR-138; miR-140; miR-141; miR-142-5p; miR-144; miR-146; miR-153; miR-154; miR-154*; miR-155; miR-17-5p; miR-182*; miR-183; miR-188; miR-189; miR-190; miR-191; miR-192; miR-197; miR-199a*; miR-19a; miR-19b; miR-20; miR-200a; miR-205; miR-206; miR-21; miR-213; miR-22; miR-220; miR-222; miR-224; miR-23b; miR-24; miR-27b; miR-28; miR-299; miR-301; miR-302a; miR-302a*; miR-302b*; miR-302c; miR-302c*; miR-30a-3p; miR-30a-5p; miR-30b; miR-30e-3p; miR-30e-5p; miR-324-5p; miR-326; miR-330; miR-335; miR-337; miR-338; miR-34a; miR-365; miR-368; miR-369; miR-373*; miR-376a; miR-376b; miR-378; miR-380-3p; miR-380-5p; miR-381; miR-382; miR-412; miR-422a; miR-422b; miR-425; miR-429; miR-433; miR-448; miR-449; miR-451; miR-7; miR-9; miR-9*; miR-93; miR-96; and miR-98. Rigid miRNAs can be down-regulated in areas of low Drosha expression by introducing mis-matches in one or more of positions 5 and/or 9-12.

Exemplary semi-rigid miRNAs include: let7a; let7e; let7g; miR-106b; miR-107; miR-122a; miR-124a; miR-126; miR-129; miR-130a; miR-133b; miR-134; miR-135a; miR-139; miR-141; miR-142-3p; miR-143; miR-144; miR-145; miR-147; miR-148a; miR-148b; miR-150; miR-151; miR-152; miR-155; miR-16; miR-17-3p; miR-181a; miR-181b; miR-181c; miR-184; miR-185; miR-186; miR-187; miR-191; miR-192; miR-194; miR-195; miR-196a; miR-198; miR-199a; miR-199b; miR-200a; miR-200c; miR-202; miR-203; miR-204; miR-21; miR-210; miR-215; miR-216; miR-217; miR-218; miR-219; miR-22; miR-224; miR-23a; miR-26a; miR-296; miR-29b; miR-29c; miR-302b; miR-302d; miR-30a-3p; miR-30b; miR-30c; miR-30d; miR-30e-3p; miR-31; miR-32; miR-323; miR-325; miR-328; miR-330; miR-331; miR-338; miR-345; miR-34a; miR-367; miR-371; miR-372; miR-373; miR-374; miR-377; miR-379; miR-380-3p; miR-383; miR-384; miR-410; miR-424; miR-425; miR-431; miR-449; miR-450; miR-452; miR-7; miR-92; miR-93; and miR-96. Semi-rigid miRNAs can be down-regulated in areas of low Drosha expression by introducing mis-matches in one or more of positions 5 and/or 9-12. Semi-rigid miRNAs can be up-regulated in areas of low Drosha expression by removing its mis-match at position 5 and/or 9-12.

Exemplary quasi-rigid miRNAs include: let7c; miR-100; miR-125a; miR-125b; miR-130b; miR-133a; miR-133a; miR-135b; miR-136; miR-148a; miR-149; miR-151; miR-15a; miR-15b; miR-16; miR-18; miR-181a; miR-181c; miR-182; miR-183; miR-196b; miR-19b; miR-200b; miR-200c; miR-202; miR-208; miR-210; miR-211; miR-212; miR-215; miR-216; miR-219; miR-221; miR-23a; miR-26b; miR-27a; miR-301; miR-30d; miR-32; miR-320; miR-324-3p; miR-33; miR-339; miR-342; miR-346; miR-34c; miR-363; miR-370; miR-372; miR-373; miR-423; miR-95; miR-99a; and miR-99b. Quasi-rigid miRNAs can be down-regulated in areas of low Drosha expression by introducing mis-matches in one or more of positions 5 and/or 9-12. Quasi-rigid miRNAs can be up-regulated in areas of low Drosha expression by removing one or more of its mis-matches at position 5 and/or 9-12.

Exemplary mis-matched miRNAs include: miR-128a; miR-128b; miR-132; miR-136; miR-193; miR-200b; miR-214; miR-25; miR-29a; miR-329; miR-340; miR-346; miR-34b; miR-375; and miR-423. Mis-matched miRNAs can be up-regulated in areas of low Drosha expression by removing mis-matches in one or more of positions 5 and/or 9-12. Mis-matched miRNAs can be down-regulated in areas of low Drosha expression by introducing one or more mis-matches at position 5 and/or 9-12.

Exemplary highly-mismatched miRNAs include: miR-340; and miR-342. Highly mis-matched miRNAs can be up-regulated in areas of low Drosha expression by removing mis-matches in one or more of positions 5 and/or 9-12.

Highly mis-matched miRNAs can be down-regulated in areas of low Drosha expression by introducing a mis-match at position 5 and/or 9-12.

Fully mis-matched miRNAs can be up-regulated in areas of low Drosha expression by removing one or more mis-matches at positions 5 and/or 9-12.

As used herein in all instances, nucleotide positions, "5 and/or 9-12" means positions 5 and/or 9 and/or 10 and/or 11 and/or 12. Potential combinations for the introduction or removal of mismatches yield the combinations of matched positions versus mis-matched positions as shown in the following Table 3.

TABLE 3

Matched vs. Mis-Matche Position Combinations in Positions 5 and/or 9-12.

| Position 5 | Position 9 | Position 10 | Position 11 | Position 12 |
|---|---|---|---|---|
| Mis-match | Mis-match | Mis-match | Mis-match | Mis-match |
| Match | Mis-match | Mis-match | Mis-match | Mis-match |
| Mis-match | Match | Mis-match | Mis-match | Mis-match |
| Mis-match | Mis-match | Match | Mis-match | Mis-match |
| Mis-match | Mis-match | Mis-match | Match | Mis-match |
| Mis-match | Mis-match | Mis-match | Mis-match | Match |
| Match | Match | Mis-match | Mis-match | Mis-match |
| Match | Mis-match | Match | Mis-match | Mis-match |
| Match | Mis-match | Mis-match | Match | Mis-match |
| Match | Mis-match | Mis-match | Mis-match | Match |
| Mis-match | Match | Match | Mis-match | Mis-match |
| Mis-match | Match | Mis-match | Match | Mis-match |
| Mis-match | Match | Mis-match | Mis-match | Match |
| Mis-match | Mis-match | Match | Match | Mis-match |
| Mis-match | Mis-match | Match | Mis-match | Match |
| Mis-match | Mis-match | Mis-match | Match | Match |
| Match | Match | Match | Mis-match | Mis-match |
| Match | Match | Mis-match | Match | Mis-match |
| Match | Match | Mis-match | Mis-match | Match |
| Match | Mis-match | Match | Match | Mis-match |
| Match | Mis-match | Match | Mis-match | Match |
| Match | Mis-match | Mis-match | Match | Match |
| Mis-match | Match | Match | Match | Mis-match |
| Mis-match | Match | Match | Mis-match | Match |
| Mis-match | Match | Mis-match | Match | Match |
| Mis-match | Mis-match | Match | Match | Match |
| Match | Match | Match | Match | Mis-match |
| Match | Match | Match | Mis-match | Match |
| Match | Match | Mis-match | Match | Match |
| Match | Mis-match | Match | Match | Match |
| Mis-match | Match | Match | Match | Match |
| Match | Match | Match | Match | Match |

Further, as used herein, "miR" refers to both hairpin structures and/or mature miRNA.

Drosha levels vary between tissues and throughout cell development. For example, the brain expresses higher levels of Drosha than the liver. Further, Drosha levels decrease over the course of T-cell development and as stem cells differentiate into neurons. These differences support the hypothesis that cells could selectively regulate RNA expression by altering Drosha expression level. This is a novel mechanism which may be utilized while designing artificial RNAs either for general stability, or to control expression levels throughout differentiation when Drosha levels change, as well as fine tuning differential expression in different tissue types.

High versus low Drosha expression can be determined or quantified by various methods. For example, in one embodiment, high versus low Drosha expression is a relative determination from samples taken from the same subject. When determined using an intra-subject comparison, high versus low can be compared from the same tissue at different time points or can be compared at the same time using a reference tissue, such as T-cells, liver or brain. Additionally, population reference standards can be created by averaging levels of Drosha expression across a group of subjects at a given time during development and for a particular tissue type. A particular subject's Drosha expression could then be appropriately compared to the population reference to determine if the particular subject's level of Drosha expression is high or low. Another option is to define Drosha expression levels according to fragments per kilobase of exon per million fragments mapped (FPKM). See, for example, the human protein atlas: http://www.proteinatlas.org/ENSG00000113360/tissue. In this method, Drosha levels of FPKM are considered high and Drosha levels <16 FPKM are considered low. Averages can be generated depending on the protein quantification method used. Within this context, the liver exhibits low Drosha expression (9 FPKM) and the brain (cerebral cortex) exhibits high Drosha expression (22 FPKM).

I. Drosha Regulation to Alter Cellular RNA Profiles

The current disclosure provides a mechanism to alter cellular RNA profiles by up- or down-regulating Drosha expression. Down-regulating Drosha expression results in a cellular RNA profile with a higher percentage of unaffected RNAs than if Drosha expression had not been down-regulated. If Drosha expression is naturally low in a cell type or period during development, up-regulating Drosha expression results in a cellular miRNA profiled with a higher percentage of affected RNA than if Drosha expression had not been up-regulated.

As used herein, "down-regulation" of Drosha means a reduction in the presence or activity of the Drosha protein. The reduction in the presence or activity lessens the physiological impact of Drosha within a cell. The down-regulation can occur due to translation of an incomplete Drosha protein sequence; incorrect folding of Drosha; or enhanced degradation of Drosha once formed. Down-regulation of Drosha can also occur due to elimination of the Drosha gene's expression (i.e. gene knockout); insertion of a nucleotide or polynucleotide molecule into the native Drosha gene sequence whereby the expression of the mutated gene is down-regulated (either partially or completely); insertion of a foreign set of base pairs in a Drosha coding region; deletion of any portion of the Drosha gene; reduced transcription of the Drosha gene; incomplete transcription of the Drosha gene; and/or interference with transcription or translation of the Drosha gene or Drosha mRNA.

An up-regulation of Drosha's activity may occur through one or more of increased presence of Drosha or increased potency of Drosha. An increased presence of Drosha can occur through its administration as a protein therapeutic, through genetic modifications that increase its expression and/or by its reduced degradation following administration or formation. Increased expression of Drosha can occur by increasing the copy number of the Drosha gene. Alternatively, a strong and/or inducible promoter may be used to direct the expression of the Drosha gene, the gene being expressed either as a transient expression vehicle or homologously or heterologously incorporated into the genome. In another embodiment, the promoter, regulatory region and/or the ribosome binding site upstream of the Drosha gene can be altered to achieve the over-expression. The expression may also be enhanced by increasing the relative half-life of Drosha mRNA. Increased potency of Drosha can occur through modifying the naturally occurring Drosha sequence to show enhanced cleavage of pri-miRNA.

As is understood by one of ordinary skill in the art, "down-regulation" and "up-regulation" can be measured against a relevant control condition.

II. miRNA Regulation Based on High or Low Drosha Expression

According to the present disclosure, miRNA can also be up- or down-regulated based on naturally occurring Drosha expression levels. For example, when Drosha expression levels are low, it may be desirable to (i) up-regulate affected RNA as these RNA naturally would be down-regulated in tissues with low Drosha expression and/or (ii) down-regulate unaffected RNA as these RNA naturally would be up-regulated in tissues with low Drosha expression. Alternatively, in areas with high Drosha expression, it may be desirable to (i) down-regulate affected RNA as these RNA naturally would be up-regulated in tissues with high Drosha expression and/or (ii) up-regulate unaffected miRNA as these miRNA naturally would be down-regulated as a percentage when compared to affected miRNA in tissues with high Drosha expression.

As used herein, "down-regulation" of RNA means a reduction in the presence or activity of an RNA. The reduction in the presence or activity lessens the physiological impact of the RNA within a cell. The down-regulation can occur due to reduced or incomplete transcription of an RNA gene sequence; enhanced degradation of RNA once it is formed; elimination of the RNA gene's expression (i.e. gene knockout); insertion of a nucleotide or polynucleotide molecule into the native gene sequence whereby expression of the mutated gene is down-regulated (either partially or completely); insertion of a foreign set of base pairs in a coding region; and/or deletion of any portion of the RNA gene.

An up-regulation of an RNA's activity may occur through one or more of increased presence or increased potency of the RNA. An increased presence of RNA can occur through its administration as a therapeutic, through genetic modifications that increase its expression and/or by its reduced degradation following administration or formation. Increased expression of RNA can occur by increasing the copy number of the RNA gene. Alternatively, a strong and/or inducible promoter may be used to direct the expression of the RNA gene, the gene being expressed either as a transient expression vehicle or homologously or heterologously incorporated into the genome. In another embodiment, the promoter, regulatory region and/or the ribosome binding site upstream of the RNA gene can be altered to achieve the over-expression. The expression may also be enhanced by increasing the relative half-life of RNA. Increased potency of miRNA can occur through modifying the naturally occurring sequence to show enhanced mRNA binding.

III. Artificial RNA Design to Provide Enhanced or Repressed RNA Processing

Based on the teachings of the present disclosure, RNA, including miRNA, can be designed to enhance or repress processing of the endogenous form of the RNA by removing or introducing mis-matches into nt positions 5 and/or 9-12 from the Drosha cutting site. Mis-matches are removed to enhance processing by making the RNA less susceptible to down-regulated Drosha expression. Mis-matches are introduced to repress processing by making RNA more susceptible to down-regulated Drosha expression.

Within the context of the designed artificial miRNAs, the term "miRNA" refers to any non-endogenous microRNA molecule that can be involved in RNA-based gene regulation. Accordingly, "miRNA" refers to any type of RNA capable of modulating the productive utilization of mRNA. The term "mRNA" refers to a nucleic acid transcribed from a gene from which a polypeptide is translated, and may include non-translated regions such as a 5'UTR and/or a 3'UTR. An miRNA can include a nucleotide sequence that is completely or partially complementary to any sequence of an mRNA molecule, including translated regions, the 5'UTR, the 3'UTR, and sequences that include both a translated region and a portion of either 5'UTR or 3'UTR. An miRNA may also comprise a nucleotide sequence that is complementary to a region of an mRNA molecule spanning the start codon or the stop codon.

Artificial miRNA can be designed based on any endogenous or naturally-occurring miRNA. Exemplary miRNA for use in the context of the current disclosure include any human, animal, or plant miRNA for various medicinal, veterinary, research, or agricultural purposes. For example, the following human miRNAs could be used: let-7a-1 (SEQ ID NO:1); let-7a-2 (SEQ ID NO:2); let-7a-3 (SEQ ID NO:3); let-7b (SEQ ID NO:4); let-7c (SEQ ID NO:5); let-7d (SEQ ID NO:6); let-7e (SEQ ID NO:7); let-7f-1 (SEQ ID NO:8); let-7f-2 (SEQ ID NO:9); let-7g (SEQ ID NO:10); let-7i (SEQ ID NO:11); miR-1-2 (SEQ ID NO:27); miR-1-1 (SEQ ID NO:26); miR-7-3 (SEQ ID NO:279); miR-7-2 (SEQ ID NO:278); miR-7-1 (SEQ ID NO:277); miR-9-3 (SEQ ID NO:286); miR-9-2 (SEQ ID NO:281); miR-9-1 (SEQ ID NO:280); miR-10a (SEQ ID NO:24); miR-10b (SEQ ID NO:25); miR-15a (SEQ ID NO:77); miR-15b (SEQ ID NO:78); miR-16-2 (SEQ ID NO:80); miR-16-1 (SEQ ID NO:79); miR-17 (SEQ ID NO:81); miR-18a (SEQ ID NO:95); miR-18b (SEQ ID NO:96); miR-19a (SEQ ID NO:114); miR-19b-1 (SEQ ID NO:115); miR-19b-2 (SEQ ID NO:116); miR-20a (SEQ ID NO:128); miR-20b (SEQ ID NO:129); miR-21 (SEQ ID NO:130); miR-22 (SEQ ID NO:144); miR-23a (SEQ ID NO:149); miR-23b (SEQ ID NO:150); miR-23c (SEQ ID NO:151); miR-24-2 (SEQ ID NO:153); miR-24-1 (SEQ ID NO:152); miR-25 (SEQ ID NO:154); miR-26a-1 (SEQ ID NO:155); miR-26a-2 (SEQ ID NO:156); miR-26b (SEQ ID NO:157); miR-27a (SEQ ID NO:158); miR-27b (SEQ ID NO:159); miR-28 (SEQ ID NO:160); miR-29a (SEQ ID NO:165); miR-29b-1 (SEQ ID NO:166); miR-29b-2 (SEQ ID NO:167); miR-29c (SEQ ID NO:168); miR-30a (SEQ ID NO:178); miR-30b (SEQ ID NO:179); miR-30c-1 (SEQ ID NO:180); miR-30c-2 (SEQ ID NO:181); miR-30d (SEQ ID NO:182); miR-30e (SEQ ID NO:183); miR-31 (SEQ ID NO:184); miR-32 (SEQ ID NO:185); miR-33a (SEQ ID NO:208); miR-33b (SEQ ID NO:209); miR-34a (SEQ ID NO:214); miR-34b (SEQ ID NO:215); miR-34c (SEQ ID NO:216); miR-92a-1 (SEQ ID NO:282); miR-92a-2 (SEQ ID NO:283); miR-92b (SEQ ID NO:284); miR-93 (SEQ ID NO:285); miR-95 (SEQ ID NO:287); miR-96 (SEQ ID NO:288); miR-98 (SEQ ID NO:289); miR-99a (SEQ ID NO:290); miR-99b (SEQ ID NO:291); miR-100 (SEQ ID NO:12); miR-101-2 (SEQ ID NO:14); miR-101-1 (SEQ ID NO:13); miR-103a-1 (SEQ ID NO:15); miR-103a-2 (SEQ ID NO:16); miR-103b-1 (SEQ ID NO:17); miR-103b-2 (SEQ ID NO:18); miR-105-2 (SEQ ID NO:20); miR-105-1 (SEQ ID NO:19); miR-106a (SEQ ID NO:21); miR-106b (SEQ ID NO:22); miR-107 (SEQ ID NO:23); miR-122 (SEQ ID NO:28); miR-124-3 (SEQ ID NO:31); miR-124-2 (SEQ ID NO:30); miR-124-1 (SEQ ID NO:29); miR-125a (SEQ ID NO:32); miR-125b-1 (SEQ ID NO:33); miR-125b-2 (SEQ ID NO:34); miR-126 (SEQ ID NO:35); miR-127 (SEQ ID NO:36); miR-128-2 (SEQ ID NO:38); miR-128-1 (SEQ ID NO:37); miR-129-2 (SEQ ID NO:40); miR-129-1 (SEQ ID NO:39); miR-130a (SEQ ID NO:41); miR-130b (SEQ ID NO:42); miR-132 (SEQ ID NO:43); miR-133a-1 (SEQ ID NO:44); miR-133a-2 (SEQ ID NO:45); miR-133b (SEQ ID NO:46); miR-134 (SEQ ID NO:47); miR-135a-1 (SEQ ID NO:48); miR-135a-2 (SEQ ID NO:49); miR-135b (SEQ ID NO:50); miR-136 (SEQ ID NO:51); miR-137 (SEQ ID NO:52); miR-138-2 (SEQ ID NO:54); miR-138-1 (SEQ ID NO:53); miR-139 (SEQ ID NO:55); miR-140 (SEQ ID NO:56); miR-141 (SEQ ID NO:57); miR-142 (SEQ ID NO:58); miR-143 (SEQ ID NO:59); miR-144 (SEQ ID NO:60); miR-145 (SEQ ID NO:61); miR-146a (SEQ ID NO:62); miR-146b (SEQ ID NO:63); miR-147a (SEQ ID NO:64); miR-147b (SEQ ID NO:65); miR-148a (SEQ ID NO:66); miR-148b (SEQ ID NO:67); miR-149 (SEQ ID NO:68); miR-150 (SEQ ID NO:69); miR-151a (SEQ ID NO:70); miR-151b (SEQ ID NO:71); miR-152 (SEQ ID NO:72); miR-153-2 (SEQ ID NO:74); miR-153-1 (SEQ ID NO:73); miR-154 (SEQ ID NO:75); miR-155 (SEQ ID NO:76); miR-181a-1 (SEQ ID NO:82); miR-181a-2 (SEQ ID NO:83); miR-181b-1 (SEQ ID NO:84); miR-181b-2 (SEQ ID NO:85); miR-181c (SEQ ID NO:86); miR-181d (SEQ ID NO:87); miR-182 (SEQ ID NO:88); miR-183 (SEQ ID NO:89); miR-184 (SEQ ID NO:90); miR-185 (SEQ ID NO:91); miR-186 (SEQ ID NO:92); miR-187 (SEQ ID NO:93); miR-188 (SEQ ID NO:94); miR-190a (SEQ ID NO:97); miR-190b (SEQ ID NO:98); miR-191 (SEQ ID NO:99); miR-192 (SEQ ID NO:100); miR-193a (SEQ ID NO:101); miR-193b (SEQ ID NO:102); miR-194-2 (SEQ ID NO:104); miR-194-1 (SEQ ID NO:103); miR-195 (SEQ ID NO:105); miR-196a-1 (SEQ ID NO:106); miR-196a-2 (SEQ ID NO:107); miR-196b (SEQ ID NO:108); miR-197 (SEQ ID NO:109); miR-198 (SEQ ID NO:110); miR-199a-1 (SEQ ID NO:111); miR-199a-2 (SEQ ID NO:112); miR-199b (SEQ ID NO:113); miR-200a (SEQ ID NO:117); miR-200b (SEQ ID NO:118); miR-200c (SEQ ID NO:119); miR-202 (SEQ ID NO:120); miR-203a (SEQ ID NO:121); miR-203b (SEQ ID NO:122); miR-204 (SEQ ID NO:123); miR-205 (SEQ ID NO:124); miR-206 (SEQ ID NO:125); miR-208a (SEQ ID NO:126); miR-208b (SEQ ID NO:127); miR-210 (SEQ ID NO:131); miR-211 (SEQ ID NO:132); miR-212 (SEQ ID NO:133); miR-214 (SEQ ID NO:134); miR-215 (SEQ ID NO:135); miR-216a (SEQ ID NO:136); miR-216b (SEQ ID NO:137); miR-217 (SEQ ID NO:138); miR-218-2 (SEQ ID NO:140); miR-218-1 (SEQ ID NO:139); miR-219a-1 (SEQ ID NO:141); miR-219a-2 (SEQ ID NO:142); miR-219b (SEQ ID NO:143); miR-221 (SEQ ID NO:145); miR-222 (SEQ ID NO:146); miR-223 (SEQ ID NO:147); miR-224 (SEQ ID NO:148); miR-296 (SEQ ID NO:161); miR-297 (SEQ ID NO:162); miR-298 (SEQ ID NO:163); miR-299 (SEQ ID NO:164); miR-300 (SEQ ID NO:169); miR-301a (SEQ ID NO:170); miR-301a (SEQ ID NO:171); miR-302a (SEQ ID NO:172); miR-302b (SEQ ID NO:173); miR-302c (SEQ ID NO:174); miR-302d (SEQ ID NO:175); miR-302e (SEQ ID NO:176); miR-302f (SEQ ID NO:177); miR-320a (SEQ ID NO:186); miR-320b-1 (SEQ ID NO:187); miR-320b-2 (SEQ ID NO:188); miR-320c-1 (SEQ ID NO:189); miR-320c-2 (SEQ ID NO:190); miR-320d-1 (SEQ ID NO:191); miR-320d-2 (SEQ ID NO:192); miR-320e (SEQ ID NO:193); miR-323a (SEQ ID NO:194); miR-323b (SEQ ID NO:195); miR-324 (SEQ ID NO:196); miR-325 (SEQ ID NO:197); miR-326 (SEQ ID NO:198); miR-328 (SEQ ID NO:199); miR-329-2 (SEQ ID NO:201); miR-329-1 (SEQ ID NO:200); miR-330 (SEQ ID NO:202); miR-331 (SEQ ID NO:203); miR-335 (SEQ ID NO:204); miR-337 (SEQ ID NO:205); miR-338 (SEQ ID NO:206); miR-339 (SEQ ID NO:207); miR-340 (SEQ ID NO:210); miR-342 (SEQ ID NO:211); miR-345 (SEQ ID NO:212); miR-346 (SEQ ID NO:213); miR-361 (SEQ ID NO:217); miR-362 (SEQ ID NO:218); miR-363 (SEQ ID NO:219); miR-365a (SEQ ID NO:220); miR-365b (SEQ ID NO:221); miR-367 (SEQ ID NO:222); miR-369 (SEQ ID NO:223); miR-370 (SEQ ID NO:224); miR-371a (SEQ ID NO:225); miR-371b (SEQ ID NO:226); miR-372 (SEQ ID NO:227); miR-373 (SEQ ID NO:228); miR-374a (SEQ ID NO:229); miR-374b (SEQ ID NO:230); miR-374c (SEQ ID NO:231); miR-375 (SEQ ID NO:232); miR-376a-1 (SEQ ID NO:233); miR-376a-2 (SEQ ID NO:234); miR-376b (SEQ ID NO:235); miR-376c (SEQ ID NO:236); miR-377 (SEQ ID NO:237); miR-378a (SEQ ID NO:238); miR-378b (SEQ ID NO:239); miR-378c (SEQ ID NO:240); miR-378d-1 (SEQ ID NO:241); miR-378d-2 (SEQ ID NO:242); miR-378e (SEQ ID NO:243); miR-378f (SEQ ID NO:244); miR-378g (SEQ ID NO:245); miR-378h (SEQ ID NO:246); miR-378i (SEQ ID NO:247); miR-378j (SEQ ID NO:248); miR-379 (SEQ ID NO:249); miR-380 (SEQ ID NO:250); miR-381 (SEQ ID NO:251); miR-382 (SEQ ID NO:252); miR-383 (SEQ ID NO:253); miR-384 (SEQ ID NO:254); miR-409 (SEQ ID NO:255); miR-410 (SEQ ID NO:256); miR-411 (SEQ ID NO:257); miR-412 (SEQ ID NO:258); miR-421 (SEQ ID NO:259); miR-422a (SEQ ID NO:260); miR-423 (SEQ ID NO:261); miR-424 (SEQ ID NO:262); miR-425 (SEQ ID NO:263); miR-429 (SEQ ID NO:264); miR-431 (SEQ ID NO:265); miR-432 (SEQ ID NO:266); miR-433 (SEQ ID NO:267); miR-448 (SEQ ID NO:268); miR-449a (SEQ ID NO:269); miR-449b (SEQ ID NO:270); miR-449c (SEQ ID NO:271); miR-450a-1 (SEQ ID NO:272); miR-450a-2 (SEQ ID NO:273); miR-450b (SEQ ID NO:274); miR-451a (SEQ ID NO:275); miR-451b (SEQ ID NO:276); miR-452 (SEQ ID NO:292); miR-454 (SEQ ID NO:293); miR-455 (SEQ ID NO:294); miR-466 (SEQ ID NO:295); miR-483 (SEQ ID NO:296); miR-484 (SEQ ID NO:297); miR-485 (SEQ ID NO:298); miR-486-2 (SEQ ID NO:300); miR-486 (SEQ ID NO:299); miR-487a (SEQ ID NO:301); miR-487b (SEQ ID NO:302); miR-488 (SEQ ID NO:303); miR-489 (SEQ ID NO:304); miR-490 (SEQ ID NO:305); miR-491 (SEQ ID NO:306); miR-492 (SEQ ID NO:307); miR-493 (SEQ ID NO:308); miR-494 (SEQ ID NO:309); miR-495 (SEQ ID NO:310); miR-496 (SEQ ID NO:311); miR-497 (SEQ ID NO:312); miR-498 (SEQ ID NO:313); miR-499a (SEQ ID NO:314); miR-499b (SEQ ID NO:315); miR-500a (SEQ ID NO:316); miR-500b (SEQ ID NO:317); miR-501 (SEQ ID NO:318); miR-502 (SEQ ID NO:319); miR-503 (SEQ ID NO:320); miR-504 (SEQ ID NO:321); miR-505 (SEQ ID NO:322); miR-506 (SEQ ID NO:323); miR-507 (SEQ ID NO:324); miR-508 (SEQ ID NO:325); miR-509-3 (SEQ ID NO:328); miR-509-2 (SEQ ID NO:327); miR-509-1 (SEQ ID NO:326); miR-510 (SEQ ID NO:329); miR-511 (SEQ ID NO:330); miR-512-2 (SEQ ID NO:332); miR-512-1 (SEQ ID NO:331); miR-513a-1 (SEQ ID NO:333); miR-513a-2 (SEQ ID NO:334); miR-513b (SEQ ID NO:335); miR-513c (SEQ ID NO:336); miR-514a-1 (SEQ ID NO:337); miR-514a-2 (SEQ ID NO:338); miR-514a-3 (SEQ ID NO:339); miR-514b (SEQ ID NO:340); miR-515-2 (SEQ ID NO:342); miR-515-1 (SEQ ID NO:341); miR-516a-1 (SEQ ID NO:343); miR-516a-2 (SEQ ID NO:344); miR-516b-1 (SEQ ID NO:345); miR-516b-2 (SEQ ID NO:346); miR-517a (SEQ ID NO:347); miR-517b (SEQ ID NO:348); miR-517c (SEQ ID NO:349); miR-518a-1 (SEQ ID NO:350); miR-518a-2 (SEQ ID NO:351); miR-518b (SEQ ID NO:352); miR-518c (SEQ ID NO:353); miR-518d (SEQ ID NO:354); miR-518e (SEQ ID NO:355); miR-518f (SEQ ID NO:356); miR-519a-1 (SEQ ID NO:357); miR-519a-2 (SEQ ID NO:358); miR-519b (SEQ ID NO:359); miR-519c (SEQ ID NO:360); miR-519d (SEQ ID NO:361); miR-519e (SEQ ID NO:362); miR-520a (SEQ ID NO:363); miR-520b (SEQ ID NO:364); miR-520c (SEQ ID NO:365); miR-520d (SEQ ID NO:366); miR-520e (SEQ ID NO:367); miR-520f (SEQ ID NO:368); miR-520g (SEQ ID NO:369); miR-520h (SEQ ID NO:370); miR-521-2 (SEQ ID NO:372); miR-521-1 (SEQ ID NO:371); miR-522 (SEQ ID NO:373); miR-523 (SEQ ID NO:374); miR-524 (SEQ ID NO:375); miR-525 (SEQ ID NO:376); miR-526a-1 (SEQ ID NO:377); miR-526a-2 (SEQ ID NO:378); miR-526b (SEQ ID NO:379); miR-527 (SEQ ID NO:380); miR-532 (SEQ ID NO:381); miR-539 (SEQ ID NO:382); miR-541 (SEQ ID NO:383); miR-542 (SEQ ID NO:384); miR-543 (SEQ ID NO:385); miR-544a (SEQ ID NO:386); miR-544b (SEQ ID NO:387); miR-545 (SEQ ID NO:388); miR-548a-1 (SEQ ID NO:389); miR-548a-2 (SEQ ID NO:390); miR-548a-3 (SEQ ID NO:391); miR-548aa-1 (SEQ ID NO:392); miR-548aa-2 (SEQ ID NO:393); miR-548ab (SEQ ID NO:394); miR-548ac (SEQ ID NO:395); miR-548ad (SEQ ID NO:396); miR-548ae-1 (SEQ ID NO:397); miR-548ae-2 (SEQ ID NO:398); miR-548ag-1 (SEQ ID NO:399); miR-548ag-2 (SEQ ID NO:400); miR-548ah (SEQ ID NO:401); miR-548ai (SEQ ID NO:402); miR-548aj-1 (SEQ ID NO:403); miR-548aj-2 (SEQ ID NO:404); miR-548ak (SEQ ID NO:405); miR-548al (SEQ ID NO:406); miR-548am (SEQ ID NO:407); miR-548an (SEQ ID NO:408); miR-548ao (SEQ ID NO:409); miR-548ap (SEQ ID NO:410); miR-548aq (SEQ ID NO:411); miR-548ar (SEQ ID NO:412); miR-548as (SEQ ID NO:413); miR-548at (SEQ ID NO:414); miR-548au (SEQ ID NO:415); miR-548av (SEQ ID NO:416); miR-548aw (SEQ ID NO:417); miR-548ax (SEQ ID NO:418); miR-548ay (SEQ ID NO:419); miR-548az (SEQ ID NO:420); miR-548b (SEQ ID NO:421); miR-548ba (SEQ ID NO:422); miR-548c (SEQ ID NO:423); miR-548d-1 (SEQ ID NO:424); miR-548d-2 (SEQ ID NO:425); miR-548e (SEQ ID NO:426); miR-548f-1 (SEQ ID NO:427); miR-548f-2 (SEQ ID NO:428); miR-548f-3 (SEQ ID NO:429); miR-548f-4 (SEQ ID NO:430); miR-548f-5 (SEQ ID NO:431); miR-548g (SEQ ID NO:432); miR-548h-1 (SEQ ID NO:433); miR-548h-2 (SEQ ID NO:434); miR-548h-3 (SEQ ID NO:435); miR-548h-4 (SEQ ID NO:436); miR-548h-5 (SEQ ID NO:437); miR-548i-1 (SEQ ID NO:438); miR-548i-2 (SEQ ID NO:439); miR-548i-3 (SEQ ID NO:440); miR-548i-4 (SEQ ID NO:441); miR-548j (SEQ ID NO:442); miR-548k (SEQ ID NO:443); miR-548l (SEQ ID NO:444); miR-548m (SEQ ID NO:445); miR-548n (SEQ ID NO:446); miR-548o (SEQ ID NO:447); miR-548o-2 (SEQ ID NO:448); miR-548p (SEQ ID NO:449); miR-548q (SEQ ID NO:450); miR-548s (SEQ ID NO:451); miR-548t (SEQ ID NO:452); miR-548u (SEQ ID NO:453); miR-548v (SEQ ID NO:454); miR-548w (SEQ ID NO:455); miR-548x (SEQ ID NO:456); miR-548x-2 (SEQ ID NO:457); miR-548y (SEQ ID NO:458); miR-548z (SEQ ID NO:459); miR-549a (SEQ ID NO:460); miR-550a-1 (SEQ ID NO:461); miR-550a-2 (SEQ ID NO:462); miR-550a-3 (SEQ ID NO:463); miR-550b-1 (SEQ ID NO:464); miR-550b-2 (SEQ ID NO:465); miR-551a (SEQ ID NO:466); miR-551b (SEQ ID NO:467); miR-552 (SEQ ID NO:468); miR-553 (SEQ ID NO:469); miR-554 (SEQ ID NO:470); miR-555 (SEQ ID NO:471); miR-556 (SEQ ID NO:472); miR-557 (SEQ ID NO:473); miR-558 (SEQ ID NO:474); miR-559 (SEQ ID NO:475); miR-561 (SEQ ID NO:476); miR-562 (SEQ ID NO:477); miR-563 (SEQ ID NO:478); miR-564 (SEQ ID NO:479); miR-566 (SEQ ID NO:480); miR-567 (SEQ ID NO:481); miR-568 (SEQ ID NO:482); miR-569 (SEQ ID NO:483); miR-570 (SEQ ID NO:484); miR-571 (SEQ ID NO:485); miR-572 (SEQ ID NO:486); miR-573 (SEQ ID NO:487); miR-574 (SEQ ID NO:488); miR-575 (SEQ ID NO:489); miR-576 (SEQ ID NO:490); miR-577 (SEQ ID NO:491); miR-578 (SEQ ID NO:492); miR-579 (SEQ ID NO:493); miR-580 (SEQ ID NO:494); miR-581 (SEQ ID NO:495); miR-582 (SEQ ID NO:496); miR-583 (SEQ ID NO:497); miR-584 (SEQ ID NO:498); miR-585 (SEQ ID NO:499); miR-586 (SEQ ID NO:500); miR-587 (SEQ ID NO:501); miR-588 (SEQ ID NO:502); miR-589 (SEQ ID NO:503); miR-590 (SEQ ID NO:504); miR-591 (SEQ ID NO:505); miR-592 (SEQ ID NO:506); miR-593 (SEQ ID NO:507); miR-595 (SEQ ID NO:508); miR-596 (SEQ ID NO:509); miR-597 (SEQ ID NO:510); miR-598 (SEQ ID NO:511); miR-599 (SEQ ID NO:512); miR-600 (SEQ ID NO:513); miR-601 (SEQ ID NO:514); miR-602 (SEQ ID NO:515); miR-603 (SEQ ID NO:516); miR-604 (SEQ ID NO:517); miR-605 (SEQ ID NO:518); miR-606 (SEQ ID NO:519); miR-607 (SEQ ID NO:520); miR-608 (SEQ ID NO:521); miR-609 (SEQ ID NO:522); miR-610 (SEQ ID NO:523); miR-611 (SEQ ID NO:524); miR-612 (SEQ ID NO:525); miR-613 (SEQ ID NO:526); miR-614 (SEQ ID NO:527); miR-615 (SEQ ID NO:528); miR-616 (SEQ ID NO:529); miR-617 (SEQ ID NO:530); miR-618 (SEQ ID NO:531); miR-619 (SEQ ID NO:532); miR-620 (SEQ ID NO:533); miR-621 (SEQ ID NO:534); miR-622 (SEQ ID NO:535); miR-623 (SEQ ID NO:536); miR-624 (SEQ ID NO:537); miR-625 (SEQ ID NO:538); miR-626 (SEQ ID NO:539); miR-627 (SEQ ID NO:540); miR-628 (SEQ ID NO:541); miR-629 (SEQ ID NO:542); miR-630 (SEQ ID NO:543); miR-631 (SEQ ID NO:544); miR-632 (SEQ ID NO:545); miR-633 (SEQ ID NO:546); miR-634 (SEQ ID NO:547); miR-635 (SEQ ID NO:548); miR-636 (SEQ ID NO:549); miR-637 (SEQ ID NO:550); miR-638 (SEQ ID NO:551); miR-639 (SEQ ID NO:552); miR-640 (SEQ ID NO:553); miR-641 (SEQ ID NO:554); miR-642a (SEQ ID NO:555); miR-642b (SEQ ID NO:556); miR-643 (SEQ ID NO:557); miR-644a (SEQ ID NO:558); miR-645 (SEQ ID NO:559); miR-646 (SEQ ID NO:560); miR-647 (SEQ ID NO:561); miR-648 (SEQ ID NO:562); miR-649 (SEQ ID NO:563); miR-650 (SEQ ID NO:564); miR-651 (SEQ ID NO:565); miR-652 (SEQ ID NO:566); miR-653 (SEQ ID NO:567); miR-654 (SEQ ID NO:568); miR-655 (SEQ ID NO:569); miR-656 (SEQ ID NO:570); miR-657 (SEQ ID NO:571); miR-658 (SEQ ID NO:572); miR-659 (SEQ ID NO:573); miR-660 (SEQ ID NO:574); miR-661 (SEQ ID NO:575); miR-662 (SEQ ID NO:576); miR-663a (SEQ ID NO:577); miR-663b (SEQ ID NO:578); miR-664a (SEQ ID NO:579); miR-664b (SEQ ID NO:580); miR-665 (SEQ ID NO:581); miR-668 (SEQ ID NO:582); miR-670 (SEQ ID NO:583); miR-671 (SEQ ID NO:584); miR-675 (SEQ ID NO:585); miR-676 (SEQ ID NO:586); miR-708 (SEQ ID NO:587); miR-711 (SEQ ID NO:588); miR-718 (SEQ ID NO:589); miR-744 (SEQ ID NO:590); miR-758 (SEQ ID NO:591); miR-759 (SEQ ID NO:592); miR-760 (SEQ ID NO:593); miR-761 (SEQ ID NO:594); miR-762 (SEQ ID NO:595); miR-764 (SEQ ID NO:596); miR-765 (SEQ ID NO:597); miR-766 (SEQ ID NO:598); miR-767 (SEQ ID NO:599); miR-769 (SEQ ID NO:600); miR-770 (SEQ ID NO:601); miR-802 (SEQ ID NO:602); miR-873 (SEQ ID NO:603); miR-874 (SEQ ID NO:604); miR-875 (SEQ ID NO:605); miR-876 (SEQ ID NO:606); miR-877 (SEQ ID NO:607); miR-885 (SEQ ID NO:608); miR-887 (SEQ ID NO:609); miR-888 (SEQ ID NO:610); miR-889 (SEQ ID NO:611); miR-890 (SEQ ID NO:612); miR-891a (SEQ ID NO:613); miR-891b (SEQ ID NO:614); miR-892a (SEQ ID NO:615); miR-892b (SEQ ID NO:616); miR-892c (SEQ ID NO:617); miR-920 (SEQ ID NO:618); miR-921 (SEQ ID NO:619); miR-922 (SEQ ID NO:620); miR-924 (SEQ ID NO:621); miR-933 (SEQ ID NO:622); miR-934 (SEQ ID NO:623); miR-935 (SEQ ID NO:624); miR-936 (SEQ ID NO:625); miR-937 (SEQ ID NO:626); miR-938 (SEQ ID NO:627); miR-939 (SEQ ID NO:628); miR-940 (SEQ ID NO:629); miR-941-4 (SEQ ID NO:633); miR-941-3 (SEQ ID NO:632); miR-941-2 (SEQ ID NO:631); miR-941-1 (SEQ ID NO:630); miR-942 (SEQ ID NO:634); miR-943 (SEQ ID NO:635); miR-944 (SEQ ID NO:636); miR-1178 (SEQ ID NO:637); miR-1179 (SEQ ID NO:638); miR-1180 (SEQ ID NO:639);

miR-1181 (SEQ ID NO:640); miR-1182 (SEQ ID NO:641); miR-1183 (SEQ ID NO:642); miR-1184-3 (SEQ ID NO:645); miR-1184-2 (SEQ ID NO:644); miR-1184-1 (SEQ ID NO:643); miR-1185-2 (SEQ ID NO:647); miR-1185-1 (SEQ ID NO:646); miR-1193 (SEQ ID NO:648); miR-1197 (SEQ ID NO:649); miR-1199 (SEQ ID NO:650); miR-1200 (SEQ ID NO:651); miR-1202 (SEQ ID NO:652); miR-1203 (SEQ ID NO:653); miR-1204 (SEQ ID NO:654); miR-1205 (SEQ ID NO:655); miR-1206 (SEQ ID NO:656); miR-1207 (SEQ ID NO:657); miR-1208 (SEQ ID NO:658); miR-1224 (SEQ ID NO:659); miR-1225 (SEQ ID NO:660); miR-1226 (SEQ ID NO:661); miR-1227 (SEQ ID NO:662); miR-1228 (SEQ ID NO:663); miR-1229 (SEQ ID NO:664); miR-1231 (SEQ ID NO:665); miR-1233-2 (SEQ ID NO:667); miR-1233-1 (SEQ ID NO:666); miR-1234 (SEQ ID NO:668); miR-1236 (SEQ ID NO:669); miR-1237 (SEQ ID NO:670); miR-1238 (SEQ ID NO:671); miR-1243 (SEQ ID NO:672); miR-1244-3 (SEQ ID NO:675); miR-1244-2 (SEQ ID NO:674); miR-1244-1 (SEQ ID NO:673); miR-1245a (SEQ ID NO:676); miR-1245b (SEQ ID NO:677); miR-1246 (SEQ ID NO:678); miR-1247 (SEQ ID NO:679); miR-1248 (SEQ ID NO:680); miR-1249 (SEQ ID NO:681); miR-1250 (SEQ ID NO:682); miR-1251 (SEQ ID NO:683); miR-1252 (SEQ ID NO:684); miR-1253 (SEQ ID NO:685); miR-1254-2 (SEQ ID NO:687); miR-1254-1 (SEQ ID NO:686); miR-1255a (SEQ ID NO:688); miR-1255b-1 (SEQ ID NO:689); miR-1255b-2 (SEQ ID NO:690); miR-1256 (SEQ ID NO:691); miR-1257 (SEQ ID NO:692); miR-1258 (SEQ ID NO:693); miR-1260a (SEQ ID NO:694); miR-1260b (SEQ ID NO:695); miR-1261 (SEQ ID NO:696); miR-1262 (SEQ ID NO:697); miR-1263 (SEQ ID NO:698); miR-1264 (SEQ ID NO:699); miR-1265 (SEQ ID NO:700); miR-1266 (SEQ ID NO:701); miR-1267 (SEQ ID NO:702); miR-1268a (SEQ ID NO:703); miR-1268b (SEQ ID NO:704); miR-1269a (SEQ ID NO:705); miR-1269b (SEQ ID NO:706); miR-1270-2 (SEQ ID NO:708); miR-1270-1 (SEQ ID NO:707); miR-1271 (SEQ ID NO:709); miR-1272 (SEQ ID NO:710); miR-1273a (SEQ ID NO:711); miR-1273c (SEQ ID NO:712); miR-1273d (SEQ ID NO:713); miR-1273e (SEQ ID NO:714); miR-1273f (SEQ ID NO:715); miR-1273g (SEQ ID NO:716); miR-1273h (SEQ ID NO:717); miR-1275 (SEQ ID NO:718); miR-1276 (SEQ ID NO:719); miR-1277 (SEQ ID NO:720); miR-1278 (SEQ ID NO:721); miR-1279 (SEQ ID NO:722); miR-1281 (SEQ ID NO:723); miR-1282 (SEQ ID NO:724); miR-1283-2 (SEQ ID NO:726); miR-1283-1 (SEQ ID NO:725); miR-1284 (SEQ ID NO:727); miR-1285-2 (SEQ ID NO:729); miR-1285-1 (SEQ ID NO:728); miR-1286 (SEQ ID NO:730); miR-1287 (SEQ ID NO:731); miR-1288 (SEQ ID NO:732); miR-1289-2 (SEQ ID NO:734); miR-1289-1 (SEQ ID NO:733); miR-1290 (SEQ ID NO:735); miR-1291 (SEQ ID NO:736); miR-1292 (SEQ ID NO:737); miR-1293 (SEQ ID NO:738); miR-1294 (SEQ ID NO:739); miR-1295a (SEQ ID NO:740); miR-1295b (SEQ ID NO:741); miR-1296 (SEQ ID NO:742); miR-1297 (SEQ ID NO:743); miR-1298 (SEQ ID NO:744); miR-1299 (SEQ ID NO:745); miR-1301 (SEQ ID NO:746); miR-1302-11 (SEQ ID NO:749); miR-1302-10 (SEQ ID NO:748); miR-1302-9 (SEQ ID NO:757); miR-1302-8 (SEQ ID NO:756); miR-1302-7 (SEQ ID NO:755); miR-1302-6 (SEQ ID NO:754); miR-1302-5 (SEQ ID NO:753); miR-1302-4 (SEQ ID NO:752); miR-1302-3 (SEQ ID NO:751); miR-1302-2 (SEQ ID NO:750); miR-1302-1 (SEQ ID NO:747); miR-1303 (SEQ ID NO:758); miR-1304 (SEQ ID NO:759); miR-1305 (SEQ ID NO:760); miR-1306 (SEQ ID NO:761); miR-1307 (SEQ ID NO:762); miR-1321 (SEQ ID NO:763); miR-1322 (SEQ ID NO:764); miR-1323 (SEQ ID NO:765); miR-1324 (SEQ ID NO:766); miR-1343 (SEQ ID NO:767); miR-1468 (SEQ ID NO:768); miR-1469 (SEQ ID NO:769); miR-1470 (SEQ ID NO:770); miR-1471 (SEQ ID NO:771); miR-1537 (SEQ ID NO:772); miR-1538 (SEQ ID NO:773); miR-1539 (SEQ ID NO:774); miR-1587 (SEQ ID NO:775); miR-1825 (SEQ ID NO:776); miR-1827 (SEQ ID NO:777); miR-1908 (SEQ ID NO:778); miR-1909 (SEQ ID NO:779); miR-1910 (SEQ ID NO:780); miR-1911 (SEQ ID NO:781); miR-1912 (SEQ ID NO:782); miR-1913 (SEQ ID NO:783); miR-1914 (SEQ ID NO:784); miR-1915 (SEQ ID NO:785); miR-1972-2 (SEQ ID NO:787); miR-1972-1 (SEQ ID NO:786); miR-1973 (SEQ ID NO:788); miR-1976 (SEQ ID NO:789); miR-2052 (SEQ ID NO:790); miR-2053 (SEQ ID NO:791); miR-2054 (SEQ ID NO:792); miR-2110 (SEQ ID NO:793); miR-2113 (SEQ ID NO:794); miR-2114 (SEQ ID NO:795); miR-2115 (SEQ ID NO:796); miR-2116 (SEQ ID NO:797); miR-2117 (SEQ ID NO:798); miR-2276 (SEQ ID NO:799); miR-2277 (SEQ ID NO:800); miR-2278 (SEQ ID NO:801); miR-2355 (SEQ ID NO:802); miR-2392 (SEQ ID NO:803); miR-2467 (SEQ ID NO:804); miR-2681 (SEQ ID NO:805); miR-2682 (SEQ ID NO:806); miR-2861 (SEQ ID NO:807); miR-2909 (SEQ ID NO:808); miR-3064 (SEQ ID NO:809); miR-3065 (SEQ ID NO:810); miR-3074 (SEQ ID NO:811); miR-3115 (SEQ ID NO:812); miR-3116-2 (SEQ ID NO:814); miR-3116-1 (SEQ ID NO:813); miR-3117 (SEQ ID NO:815); miR-3118-6 (SEQ ID NO:821); miR-3118-5 (SEQ ID NO:820); miR-3118-4 (SEQ ID NO:819); miR-3118-3 (SEQ ID NO:818); miR-3118-2 (SEQ ID NO:817); miR-3118-1 (SEQ ID NO:816); miR-3119-2 (SEQ ID NO:823); miR-3119-1 (SEQ ID NO:822); miR-3120 (SEQ ID NO:824); miR-3121 (SEQ ID NO:825); miR-3122 (SEQ ID NO:826); miR-3123 (SEQ ID NO:827); miR-3124 (SEQ ID NO:828); miR-3125 (SEQ ID NO:829); miR-3126 (SEQ ID NO:830); miR-3127 (SEQ ID NO:831); miR-3128 (SEQ ID NO:832); miR-3129 (SEQ ID NO:833); miR-3130-2 (SEQ ID NO:835); miR-3130-1 (SEQ ID NO:834); miR-3131 (SEQ ID NO:836); miR-3132 (SEQ ID NO:837); miR-3133 (SEQ ID NO:838); miR-3134 (SEQ ID NO:839); miR-3135a (SEQ ID NO:840); miR-3135b (SEQ ID NO:841); miR-3136 (SEQ ID NO:842); miR-3137 (SEQ ID NO:843); miR-3138 (SEQ ID NO:844); miR-3139 (SEQ ID NO:845); miR-3140 (SEQ ID NO:846); miR-3141 (SEQ ID NO:847); miR-3142 (SEQ ID NO:848); miR-3143 (SEQ ID NO:849); miR-3144 (SEQ ID NO:850); miR-3145 (SEQ ID NO:851); miR-3146 (SEQ ID NO:852); miR-3147 (SEQ ID NO:853); miR-3148 (SEQ ID NO:854); miR-3149 (SEQ ID NO:855); miR-3150a (SEQ ID NO:856); miR-3150b (SEQ ID NO:857); miR-3151 (SEQ ID NO:858); miR-3152 (SEQ ID NO:859); miR-3153 (SEQ ID NO:860); miR-3154 (SEQ ID NO:861); miR-3155a (SEQ ID NO:862); miR-3155b (SEQ ID NO:863); miR-3156-3 (SEQ ID NO:866); miR-3156-2 (SEQ ID NO:865); miR-3156-1 (SEQ ID NO:864); miR-3157 (SEQ ID NO:867); miR-3158-2 (SEQ ID NO:869); miR-3158-1 (SEQ ID NO:868); miR-3159 (SEQ ID NO:870); miR-3160-2 (SEQ ID NO:872); miR-3160-1 (SEQ ID NO:871); miR-3161 (SEQ ID NO:873); miR-3162 (SEQ ID NO:874); miR-3163 (SEQ ID NO:875); miR-3164 (SEQ ID NO:876); miR-3165 (SEQ ID NO:877); miR-3166 (SEQ ID NO:878); miR-3167 (SEQ ID NO:879); miR-3168 (SEQ ID NO:880); miR-3169 (SEQ ID NO:881); miR-3170 (SEQ ID NO:882); miR-3171 (SEQ ID NO:883); miR-3173 (SEQ ID NO:884); miR-3174 (SEQ ID NO:885); miR-3175 (SEQ ID NO:886); miR-3176 (SEQ ID NO:887); miR-3177 (SEQ ID NO:888); miR-3178 (SEQ ID NO:889); miR-3179-3 (SEQ ID NO:892); miR-3179-2 (SEQ ID NO:891); miR-3179-1 (SEQ ID NO:890); miR-3180-5 (SEQ ID NO:897); miR-3180-4 (SEQ ID NO:896); miR-3180-3 (SEQ ID NO:895); miR-3180-2 (SEQ ID NO:894); miR-3180-1

(SEQ ID NO:893); miR-3181 (SEQ ID NO:898); miR-3182 (SEQ ID NO:899); miR-3183 (SEQ ID NO:900); miR-3184 (SEQ ID NO:901); miR-3185 (SEQ ID NO:902); miR-3186 (SEQ ID NO:903); miR-3187 (SEQ ID NO:904); miR-3188 (SEQ ID NO:905); miR-3189 (SEQ ID NO:906); miR-3190 (SEQ ID NO:907); miR-3191 (SEQ ID NO:908); miR-3192 (SEQ ID NO:909); miR-3193 (SEQ ID NO:910); miR-3194 (SEQ ID NO:911); miR-3195 (SEQ ID NO:912); miR-3196 (SEQ ID NO:913); miR-3197 (SEQ ID NO:914); miR-3198-2 (SEQ ID NO:916); miR-3198-1 (SEQ ID NO:915); miR-3199-2 (SEQ ID NO:918); miR-3199-1 (SEQ ID NO:917); miR-3200 (SEQ ID NO:919); miR-3201 (SEQ ID NO:920); miR-3202-2 (SEQ ID NO:922); miR-3202-1 (SEQ ID NO:921); miR-3529 (SEQ ID NO:923); miR-3591 (SEQ ID NO:924); miR-3605 (SEQ ID NO:925); miR-3606 (SEQ ID NO:926); miR-3607 (SEQ ID NO:927); miR-3609 (SEQ ID NO:928); miR-3610 (SEQ ID NO:929); miR-3611 (SEQ ID NO:930); miR-3612 (SEQ ID NO:931); miR-3613 (SEQ ID NO:932); miR-3614 (SEQ ID NO:933); miR-3615 (SEQ ID NO:934); miR-3616 (SEQ ID NO:935); miR-3617 (SEQ ID NO:936); miR-3618 (SEQ ID NO:937); miR-3619 (SEQ ID NO:938); miR-3620 (SEQ ID NO:939); miR-3621 (SEQ ID NO:940); miR-3622a (SEQ ID NO:941); miR-3622b (SEQ ID NO:942); miR-3646 (SEQ ID NO:943); miR-3648 (SEQ ID NO:944); miR-3649 (SEQ ID NO:945); miR-3650 (SEQ ID NO:946); miR-3651 (SEQ ID NO:947); miR-3652 (SEQ ID NO:948); miR-3653 (SEQ ID NO:949); miR-3654 (SEQ ID NO:950); miR-3655 (SEQ ID NO:951); miR-3656 (SEQ ID NO:952); miR-3657 (SEQ ID NO:953); miR-3658 (SEQ ID NO:954); miR-3659 (SEQ ID NO:955); miR-3660 (SEQ ID NO:956); miR-3661 (SEQ ID NO:957); miR-3662 (SEQ ID NO:958); miR-3663 (SEQ ID NO:959); miR-3664 (SEQ ID NO:960); miR-3665 (SEQ ID NO:961); miR-3666 (SEQ ID NO:962); miR-3667 (SEQ ID NO:963); miR-3668 (SEQ ID NO:964); miR-3669 (SEQ ID NO:965); miR-3670-2 (SEQ ID NO:967); miR-3670-1 (SEQ ID NO:966); miR-3671 (SEQ ID NO:968); miR-3672 (SEQ ID NO:969); miR-3673 (SEQ ID NO:970); miR-3674 (SEQ ID NO:971); miR-3675 (SEQ ID NO:972); miR-3677 (SEQ ID NO:973); miR-3678 (SEQ ID NO:974); miR-3679 (SEQ ID NO:975); miR-3680-2 (SEQ ID NO:977); miR-3680-1 (SEQ ID NO:976); miR-3681 (SEQ ID NO:978); miR-3682 (SEQ ID NO:979); miR-3683 (SEQ ID NO:980); miR-3684 (SEQ ID NO:981); miR-3685 (SEQ ID NO:982); miR-3686 (SEQ ID NO:983); miR-3687 (SEQ ID NO:984); miR-3688-2 (SEQ ID NO:986); miR-3688-1 (SEQ ID NO:985); miR-3689a (SEQ ID NO:987); miR-3689b (SEQ ID NO:988); miR-3689c (SEQ ID NO:989); miR-3689d-1 (SEQ ID NO:990); miR-3689d-2 (SEQ ID NO:991); miR-3689e (SEQ ID NO:992); miR-3689f (SEQ ID NO:993); miR-3690-2 (SEQ ID NO:995); miR-3690-1 (SEQ ID NO:994); miR-3691 (SEQ ID NO:996); miR-3692 (SEQ ID NO:997); miR-3713 (SEQ ID NO:998); miR-3714 (SEQ ID NO:999); miR-3907 (SEQ ID NO:1000); miR-3908 (SEQ ID NO:1001); miR-3909 (SEQ ID NO:1002); miR-3910-2 (SEQ ID NO:1004); miR-3910-1 (SEQ ID NO:1003); miR-3911 (SEQ ID NO:1005); miR-3912 (SEQ ID NO:1006); miR-3913-2 (SEQ ID NO:1008); miR-3913-1 (SEQ ID NO:1007); miR-3914-2 (SEQ ID NO:1010); miR-3914-1 (SEQ ID NO:1009); miR-3915 (SEQ ID NO:1011); miR-3916 (SEQ ID NO:1012); miR-3917 (SEQ ID NO:1013); miR-3918 (SEQ ID NO:1014); miR-3919 (SEQ ID NO:1015); miR-3920 (SEQ ID NO:1016); miR-3921 (SEQ ID NO:1017); miR-3922 (SEQ ID NO:1018); miR-3923 (SEQ ID NO:1019); miR-3924 (SEQ ID NO:1020); miR-3925 (SEQ ID NO:1021); miR-3926-2 (SEQ ID NO:1023); miR-3926-1 (SEQ ID NO:1022); miR-3927 (SEQ ID NO:1024); miR-3928 (SEQ ID NO:1025); miR-3929 (SEQ ID NO:1026); miR-3934 (SEQ ID NO:1027); miR-3935 (SEQ ID NO:1028); miR-3936 (SEQ ID NO:1029); miR-3937 (SEQ ID NO:1030); miR-3938 (SEQ ID NO:1031); miR-3939 (SEQ ID NO:1032); miR-3940 (SEQ ID NO:1033); miR-3941 (SEQ ID NO:1034); miR-3942 (SEQ ID NO:1035); miR-3943 (SEQ ID NO:1036); miR-3944 (SEQ ID NO:1037); miR-3945 (SEQ ID NO:1038); miR-3960 (SEQ ID NO:1039); miR-3972 (SEQ ID NO:1040); miR-3973 (SEQ ID NO:1041); miR-3974 (SEQ ID NO:1042); miR-3975 (SEQ ID NO:1043); miR-3976 (SEQ ID NO:1044); miR-3977 (SEQ ID NO:1045); miR-3978 (SEQ ID NO:1046); miR-4251 (SEQ ID NO:1047); miR-4252 (SEQ ID NO:1048); miR-4253 (SEQ ID NO:1049); miR-4254 (SEQ ID NO:1050); miR-4255 (SEQ ID NO:1051); miR-4256 (SEQ ID NO:1052); miR-4257 (SEQ ID NO:1053); miR-4258 (SEQ ID NO:1054); miR-4259 (SEQ ID NO:1055); miR-4260 (SEQ ID NO:1056); miR-4261 (SEQ ID NO:1057); miR-4262 (SEQ ID NO:1058); miR-4263 (SEQ ID NO:1059); miR-4264 (SEQ ID NO:1060); miR-4265 (SEQ ID NO:1061); miR-4266 (SEQ ID NO:1062); miR-4267 (SEQ ID NO:1063); miR-4268 (SEQ ID NO:1064); miR-4269 (SEQ ID NO:1065); miR-4270 (SEQ ID NO:1066); miR-4271 (SEQ ID NO:1067); miR-4272 (SEQ ID NO:1068); miR-4273 (SEQ ID NO:1069); miR-4274 (SEQ ID NO:1070); miR-4275 (SEQ ID NO:1071); miR-4276 (SEQ ID NO:1072); miR-4277 (SEQ ID NO:1073); miR-4278 (SEQ ID NO:1074); miR-4279 (SEQ ID NO:1075); miR-4280 (SEQ ID NO:1076); miR-4281 (SEQ ID NO:1077); miR-4282 (SEQ ID NO:1078); miR-4283-2 (SEQ ID NO:1080); miR-4283-1 (SEQ ID NO:1079); miR-4284 (SEQ ID NO:1081); miR-4285 (SEQ ID NO:1082); miR-4286 (SEQ ID NO:1083); miR-4287 (SEQ ID NO:1084); miR-4288 (SEQ ID NO:1085); miR-4289 (SEQ ID NO:1086); miR-4290 (SEQ ID NO:1087); miR-4291 (SEQ ID NO:1088); miR-4292 (SEQ ID NO:1089); miR-4293 (SEQ ID NO:1090); miR-4294 (SEQ ID NO:1091); miR-4295 (SEQ ID NO:1092); miR-4296 (SEQ ID NO:1093); miR-4297 (SEQ ID NO:1094); miR-4298 (SEQ ID NO:1095); miR-4299 (SEQ ID NO:1096); miR-4300 (SEQ ID NO:1097); miR-4301 (SEQ ID NO:1098); miR-4302 (SEQ ID NO:1099); miR-4303 (SEQ ID NO:1100); miR-4304 (SEQ ID NO:1101); miR-4305 (SEQ ID NO:1102); miR-4306 (SEQ ID NO:1103); miR-4307 (SEQ ID NO:1104); miR-4308 (SEQ ID NO:1105); miR-4309 (SEQ ID NO:1106); miR-4310 (SEQ ID NO:1107); miR-4311 (SEQ ID NO:1108); miR-4312 (SEQ ID NO:1109); miR-4313 (SEQ ID NO:1110); miR-4314 (SEQ ID NO:1111); miR-4315-2 (SEQ ID NO:1113); miR-4315-1 (SEQ ID NO:1112); miR-4316 (SEQ ID NO:1114); miR-4317 (SEQ ID NO:1115); miR-4318 (SEQ ID NO:1116); miR-4319 (SEQ ID NO:1117); miR-4320 (SEQ ID NO:1118); miR-4321 (SEQ ID NO:1119); miR-4322 (SEQ ID NO:1120); miR-4323 (SEQ ID NO:1121); miR-4324 (SEQ ID NO:1122); miR-4325 (SEQ ID NO:1123); miR-4326 (SEQ ID NO:1124); miR-4327 (SEQ ID NO:1125); miR-4328 (SEQ ID NO:1126); miR-4329 (SEQ ID NO:1127); miR-4330 (SEQ ID NO:1128); miR-4417 (SEQ ID NO:1129); miR-4418 (SEQ ID NO:1130); miR-4419a (SEQ ID NO:1131); miR-4419b (SEQ ID NO:1132); miR-4420 (SEQ ID NO:1133); miR-4421 (SEQ ID NO:1134); miR-4422 (SEQ ID NO:1135); miR-4423 (SEQ ID NO:1136); miR-4424 (SEQ ID NO:1137); miR-4425 (SEQ ID NO:1138); miR-4426 (SEQ ID NO:1139); miR-4427 (SEQ ID NO:1140); miR-4428 (SEQ ID NO:1141); miR-4429 (SEQ ID NO:1142); miR-4430 (SEQ ID NO:1143); miR-4431 (SEQ ID NO:1144); miR-4432 (SEQ ID

NO:1145); miR-4433b (SEQ ID NO:1147); miR-4433 (SEQ ID NO:1146); miR-4434 (SEQ ID NO:1148); miR-4435-2 (SEQ ID NO:1150); miR-4435-1 (SEQ ID NO:1149); miR-4436a (SEQ ID NO:1151); miR-4436b-1 (SEQ ID NO:1152); miR-4436b-2 (SEQ ID NO:1153); miR-4437 (SEQ ID NO:1154); miR-4438 (SEQ ID NO:1155); miR-4439 (SEQ ID NO:1156); miR-4440 (SEQ ID NO:1157); miR-4441 (SEQ ID NO:1158); miR-4442 (SEQ ID NO:1159); miR-4443 (SEQ ID NO:1160); miR-4444-2 (SEQ ID NO:1162); miR-4444-1 (SEQ ID NO:1161); miR-4445 (SEQ ID NO:1163); miR-4446 (SEQ ID NO:1164); miR-4447 (SEQ ID NO:1165); miR-4448 (SEQ ID NO:1166); miR-4449 (SEQ ID NO:1167); miR-4450 (SEQ ID NO:1168); miR-4451 (SEQ ID NO:1169); miR-4452 (SEQ ID NO:1170); miR-4453 (SEQ ID NO:1171); miR-4454 (SEQ ID NO:1172); miR-4455 (SEQ ID NO:1173); miR-4456 (SEQ ID NO:1174); miR-4457 (SEQ ID NO:1175); miR-4458 (SEQ ID NO:1176); miR-4459 (SEQ ID NO:1177); miR-4460 (SEQ ID NO:1178); miR-4461 (SEQ ID NO:1179); miR-4462 (SEQ ID NO:1180); miR-4463 (SEQ ID NO:1181); miR-4464 (SEQ ID NO:1182); miR-4465 (SEQ ID NO:1183); miR-4466 (SEQ ID NO:1184); miR-4467 (SEQ ID NO:1185); miR-4468 (SEQ ID NO:1186); miR-4469 (SEQ ID NO:1187); miR-4470 (SEQ ID NO:1188); miR-4471 (SEQ ID NO:1189); miR-4472-2 (SEQ ID NO:1191); miR-4472-1 (SEQ ID NO:1190); miR-4473 (SEQ ID NO:1192); miR-4474 (SEQ ID NO:1193); miR-4475 (SEQ ID NO:1194); miR-4476 (SEQ ID NO:1195); miR-4477a (SEQ ID NO:1196); miR-4477b (SEQ ID NO:1197); miR-4478 (SEQ ID NO:1198); miR-4479 (SEQ ID NO:1199); miR-4480 (SEQ ID NO:1200); miR-4481 (SEQ ID NO:1201); miR-4482 (SEQ ID NO:1202); miR-4483 (SEQ ID NO:1203); miR-4484 (SEQ ID NO:1204); miR-4485 (SEQ ID NO:1205); miR-4486 (SEQ ID NO:1206); miR-4487 (SEQ ID NO:1207); miR-4488 (SEQ ID NO:1208); miR-4489 (SEQ ID NO:1209); miR-4490 (SEQ ID NO:1210); miR-4491 (SEQ ID NO:1211); miR-4492 (SEQ ID NO:1212); miR-4493 (SEQ ID NO:1213); miR-4494 (SEQ ID NO:1214); miR-4495 (SEQ ID NO:1215); miR-4496 (SEQ ID NO:1216); miR-4497 (SEQ ID NO:1217); miR-4498 (SEQ ID NO:1218); miR-4499 (SEQ ID NO:1219); miR-4500 (SEQ ID NO:1220); miR-4501 (SEQ ID NO:1221); miR-4502 (SEQ ID NO:1222); miR-4503 (SEQ ID NO:1223); miR-4504 (SEQ ID NO:1224); miR-4505 (SEQ ID NO:1225); miR-4506 (SEQ ID NO:1226); miR-4507 (SEQ ID NO:1227); miR-4508 (SEQ ID NO:1228); miR-4509-3 (SEQ ID NO:1231); miR-4509-2 (SEQ ID NO:1230); miR-4509-1 (SEQ ID NO:1229); miR-4510 (SEQ ID NO:1232); miR-4511 (SEQ ID NO:1233); miR-4512 (SEQ ID NO:1234); miR-4513 (SEQ ID NO:1235); miR-4514 (SEQ ID NO:1236); miR-4515 (SEQ ID NO:1237); miR-4516 (SEQ ID NO:1238); miR-4517 (SEQ ID NO:1239); miR-4518 (SEQ ID NO:1240); miR-4519 (SEQ ID NO:1241); miR-4520a (SEQ ID NO:1242); miR-4520b (SEQ ID NO:1243); miR-4521 (SEQ ID NO:1244); miR-4522 (SEQ ID NO:1245); miR-4523 (SEQ ID NO:1246); miR-4524a (SEQ ID NO:1247); miR-4524b (SEQ ID NO:1248); miR-4525 (SEQ ID NO:1249); miR-4526 (SEQ ID NO:1250); miR-4527 (SEQ ID NO:1251); miR-4528 (SEQ ID NO:1252); miR-4529 (SEQ ID NO:1253); miR-4530 (SEQ ID NO:1254); miR-4531 (SEQ ID NO:1255); miR-4532 (SEQ ID NO:1256); miR-4533 (SEQ ID NO:1257); miR-4534 (SEQ ID NO:1258); miR-4535 (SEQ ID NO:1259); miR-4536-2 (SEQ ID NO:1261); miR-4536-1 (SEQ ID NO:1260); miR-4537 (SEQ ID NO:1262); miR-4538 (SEQ ID NO:1263); miR-4539 (SEQ ID NO:1264); miR-4540 (SEQ ID NO:1265); miR-4632 (SEQ ID NO:1266); miR-4633 (SEQ ID NO:1267); miR-4634 (SEQ ID NO:1268); miR-4635 (SEQ ID NO:1269); miR-4636 (SEQ ID NO:1270); miR-4637 (SEQ ID NO:1271); miR-4638 (SEQ ID NO:1272); miR-4639 (SEQ ID NO:1273); miR-4640 (SEQ ID NO:1274); miR-4641 (SEQ ID NO:1275); miR-4642 (SEQ ID NO:1276); miR-4643 (SEQ ID NO:1277); miR-4644 (SEQ ID NO:1278); miR-4645 (SEQ ID NO:1279); miR-4646 (SEQ ID NO:1280); miR-4647 (SEQ ID NO:1281); miR-4648 (SEQ ID NO:1282); miR-4649 (SEQ ID NO:1283); miR-4650-2 (SEQ ID NO:1285); miR-4650-1 (SEQ ID NO:1284); miR-4651 (SEQ ID NO:1286); miR-4652 (SEQ ID NO:1287); miR-4653 (SEQ ID NO:1288); miR-4654 (SEQ ID NO:1289); miR-4655 (SEQ ID NO:1290); miR-4656 (SEQ ID NO:1291); miR-4657 (SEQ ID NO:1292); miR-4658 (SEQ ID NO:1293); miR-4659a (SEQ ID NO:1294); miR-4659b (SEQ ID NO:1295); miR-4660 (SEQ ID NO:1296); miR-4661 (SEQ ID NO:1297); miR-4662a (SEQ ID NO:1298); miR-4662b (SEQ ID NO:1299); miR-4663 (SEQ ID NO:1300); miR-4664 (SEQ ID NO:1301); miR-4665 (SEQ ID NO:1302); miR-4666a (SEQ ID NO:1303); miR-4666b (SEQ ID NO:1304); miR-4667 (SEQ ID NO:1305); miR-4668 (SEQ ID NO:1306); miR-4669 (SEQ ID NO:1307); miR-4670 (SEQ ID NO:1308); miR-4671 (SEQ ID NO:1309); miR-4672 (SEQ ID NO:1310); miR-4673 (SEQ ID NO:1311); miR-4674 (SEQ ID NO:1312); miR-4675 (SEQ ID NO:1313); miR-4676 (SEQ ID NO:1314); miR-4677 (SEQ ID NO:1315); miR-4678 (SEQ ID NO:1316); miR-4679-2 (SEQ ID NO:1318); miR-4679-1 (SEQ ID NO:1317); miR-4680 (SEQ ID NO:1319); miR-4681 (SEQ ID NO:1320); miR-4682 (SEQ ID NO:1321); miR-4683 (SEQ ID NO:1322); miR-4684 (SEQ ID NO:1323); miR-4685 (SEQ ID NO:1324); miR-4686 (SEQ ID NO:1325); miR-4687 (SEQ ID NO:1326); miR-4688 (SEQ ID NO:1327); miR-4689 (SEQ ID NO:1328); miR-4690 (SEQ ID NO:1329); miR-4691 (SEQ ID NO:1330); miR-4692 (SEQ ID NO:1331); miR-4693 (SEQ ID NO:1332); miR-4694 (SEQ ID NO:1333); miR-4695 (SEQ ID NO:1334); miR-4696 (SEQ ID NO:1335); miR-4697 (SEQ ID NO:1336); miR-4698 (SEQ ID NO:1337); miR-4699 (SEQ ID NO:1338); miR-4700 (SEQ ID NO:1339); miR-4701 (SEQ ID NO:1340); miR-4703 (SEQ ID NO:1341); miR-4704 (SEQ ID NO:1342); miR-4705 (SEQ ID NO:1343); miR-4706 (SEQ ID NO:1344); miR-4707 (SEQ ID NO:1345); miR-4708 (SEQ ID NO:1346); miR-4709 (SEQ ID NO:1347); miR-4710 (SEQ ID NO:1348); miR-4711 (SEQ ID NO:1349); miR-4712 (SEQ ID NO:1350); miR-4713 (SEQ ID NO:1351); miR-4714 (SEQ ID NO:1352); miR-4715 (SEQ ID NO:1353); miR-4716 (SEQ ID NO:1354); miR-4717 (SEQ ID NO:1355); miR-4718 (SEQ ID NO:1356); miR-4719 (SEQ ID NO:1357); miR-4720 (SEQ ID NO:1358); miR-4721 (SEQ ID NO:1359); miR-4722 (SEQ ID NO:1360); miR-4723 (SEQ ID NO:1361); miR-4724 (SEQ ID NO:1362); miR-4725 (SEQ ID NO:1363); miR-4726 (SEQ ID NO:1364); miR-4727 (SEQ ID NO:1365); miR-4728 (SEQ ID NO:1366); miR-4729 (SEQ ID NO:1367); miR-4730 (SEQ ID NO:1368); miR-4731 (SEQ ID NO:1369); miR-4732 (SEQ ID NO:1370); miR-4733 (SEQ ID NO:1371); miR-4734 (SEQ ID NO:1372); miR-4735 (SEQ ID NO:1373); miR-4736 (SEQ ID NO:1374); miR-4737 (SEQ ID NO:1375); miR-4738 (SEQ ID NO:1376); miR-4739 (SEQ ID NO:1377); miR-4740 (SEQ ID NO:1378); miR-4741 (SEQ ID NO:1379); miR-4742 (SEQ ID NO:1380); miR-4743 (SEQ ID NO:1381); miR-4744 (SEQ ID NO:1382); miR-4745 (SEQ ID NO:1383); miR-4746 (SEQ ID NO:1384); miR-4747 (SEQ ID NO:1385);

miR-4748 (SEQ ID NO:1386); miR-4749 (SEQ ID NO:1387); miR-4750 (SEQ ID NO:1388); miR-4751 (SEQ ID NO:1389); miR-4752 (SEQ ID NO:1390); miR-4753 (SEQ ID NO:1391); miR-4754 (SEQ ID NO:1392); miR-4755 (SEQ ID NO:1393); miR-4756 (SEQ ID NO:1394); miR-4757 (SEQ ID NO:1395); miR-4758 (SEQ ID NO:1396); miR-4759 (SEQ ID NO:1397); miR-4760 (SEQ ID NO:1398); miR-4761 (SEQ ID NO:1399); miR-4762 (SEQ ID NO:1400); miR-4763 (SEQ ID NO:1401); miR-4764 (SEQ ID NO:1402); miR-4765 (SEQ ID NO:1403); miR-4766 (SEQ ID NO:1404); miR-4767 (SEQ ID NO:1405); miR-4768 (SEQ ID NO:1406); miR-4769 (SEQ ID NO:1407); miR-4770 (SEQ ID NO:1408); miR-4771-2 (SEQ ID NO:1410); miR-4771-1 (SEQ ID NO:1409); miR-4772 (SEQ ID NO:1411); miR-4773-2 (SEQ ID NO:1413); miR-4773-1 (SEQ ID NO:1412); miR-4774 (SEQ ID NO:1414); miR-4775 (SEQ ID NO:1415); miR-4776-2 (SEQ ID NO:1417); miR-4776-1 (SEQ ID NO:1416); miR-4777 (SEQ ID NO:1418); miR-4778 (SEQ ID NO:1419); miR-4779 (SEQ ID NO:1420); miR-4780 (SEQ ID NO:1421); miR-4781 (SEQ ID NO:1422); miR-4782 (SEQ ID NO:1423); miR-4783 (SEQ ID NO:1424); miR-4784 (SEQ ID NO:1425); miR-4785 (SEQ ID NO:1426); miR-4786 (SEQ ID NO:1427); miR-4787 (SEQ ID NO:1428); miR-4788 (SEQ ID NO:1429); miR-4789 (SEQ ID NO:1430); miR-4790 (SEQ ID NO:1431); miR-4791 (SEQ ID NO:1432); miR-4792 (SEQ ID NO:1433); miR-4793 (SEQ ID NO:1434); miR-4794 (SEQ ID NO:1435); miR-4795 (SEQ ID NO:1436); miR-4796 (SEQ ID NO:1437); miR-4797 (SEQ ID NO:1438); miR-4798 (SEQ ID NO:1439); miR-4799 (SEQ ID NO:1440); miR-4800 (SEQ ID NO:1441); miR-4801 (SEQ ID NO:1442); miR-4802 (SEQ ID NO:1443); miR-4803 (SEQ ID NO:1444); miR-4804 (SEQ ID NO:1445); miR-4999 (SEQ ID NO:1446); miR-5000 (SEQ ID NO:1447); miR-5001 (SEQ ID NO:1448); miR-5002 (SEQ ID NO:1449); miR-5003 (SEQ ID NO:1450); miR-5004 (SEQ ID NO:1451); miR-5006 (SEQ ID NO:1452); miR-5007 (SEQ ID NO:1453); miR-5008 (SEQ ID NO:1454); miR-5009 (SEQ ID NO:1455); miR-5010 (SEQ ID NO:1456); miR-5011 (SEQ ID NO:1457); miR-5047 (SEQ ID NO:1458); miR-5087 (SEQ ID NO:1459); miR-5088 (SEQ ID NO:1460); miR-5089 (SEQ ID NO:1461); miR-5090 (SEQ ID NO:1462); miR-5091 (SEQ ID NO:1463); miR-5092 (SEQ ID NO:1464); miR-5093 (SEQ ID NO:1465); miR-5094 (SEQ ID NO:1466); miR-5095 (SEQ ID NO:1467); miR-5096 (SEQ ID NO:1468); miR-5100 (SEQ ID NO:1469); miR-5186 (SEQ ID NO:1470); miR-5187 (SEQ ID NO:1471); miR-5188 (SEQ ID NO:1472); miR-5189 (SEQ ID NO:1473); miR-5190 (SEQ ID NO:1474); miR-5191 (SEQ ID NO:1475); miR-5192 (SEQ ID NO:1476); miR-5193 (SEQ ID NO:1477); miR-5194 (SEQ ID NO:1478); miR-5195 (SEQ ID NO:1479); miR-5196 (SEQ ID NO:1480); miR-5197 (SEQ ID NO:1481); miR-5571 (SEQ ID NO:1482); miR-5572 (SEQ ID NO:1483); miR-5579 (SEQ ID NO:1484); miR-5580 (SEQ ID NO:1485); miR-5581 (SEQ ID NO:1486); miR-5582 (SEQ ID NO:1487); miR-5583-2 (SEQ ID NO:1489); miR-5583-1 (SEQ ID NO:1488); miR-5584 (SEQ ID NO:1490); miR-5585 (SEQ ID NO:1491); miR-5586 (SEQ ID NO:1492); miR-5587 (SEQ ID NO:1493); miR-5588 (SEQ ID NO:1494); miR-5589 (SEQ ID NO:1495); miR-5590 (SEQ ID NO:1496); miR-5591 (SEQ ID NO:1497); miR-5680 (SEQ ID NO:1498); miR-5681a (SEQ ID NO:1499); miR-5681b (SEQ ID NO:1500); miR-5682 (SEQ ID NO:1501); miR-5683 (SEQ ID NO:1502); miR-5684 (SEQ ID NO:1503); miR-5685 (SEQ ID NO:1504); miR-5687 (SEQ ID NO:1505); miR-5688 (SEQ ID NO:1506); miR-5689 (SEQ ID NO:1507); miR-5690 (SEQ ID NO:1508); miR-5691 (SEQ ID NO:1509); miR-5692a-1 (SEQ ID NO:1510); miR-5692a-2 (SEQ ID NO:1511); miR-5692b (SEQ ID NO:1512); miR-5692c-1 (SEQ ID NO:1513); miR-5692c-2 (SEQ ID NO:1514); miR-5693 (SEQ ID NO:1515); miR-5694 (SEQ ID NO:1516); miR-5695 (SEQ ID NO:1517); miR-5696 (SEQ ID NO:1518); miR-5697 (SEQ ID NO:1519); miR-5698 (SEQ ID NO:1520); miR-5699 (SEQ ID NO:1521); miR-5700 (SEQ ID NO:1522); miR-5701-2 (SEQ ID NO:1524); miR-5701-1 (SEQ ID NO:1523); miR-5702 (SEQ ID NO:1525); miR-5703 (SEQ ID NO:1526); miR-5704 (SEQ ID NO:1527); miR-5705 (SEQ ID NO:1528); miR-5706 (SEQ ID NO:1529); miR-5707 (SEQ ID NO:1530); miR-5708 (SEQ ID NO:1531); miR-5739 (SEQ ID NO:1532); miR-5787 (SEQ ID NO:1533); miR-6068 (SEQ ID NO:1534); miR-6069 (SEQ ID NO:1535); miR-6070 (SEQ ID NO:1536); miR-6071 (SEQ ID NO:1537); miR-6072 (SEQ ID NO:1538); miR-6073 (SEQ ID NO:1539); miR-6074 (SEQ ID NO:1540); miR-6075 (SEQ ID NO:1541); miR-6076 (SEQ ID NO:1542); miR-6077-2 (SEQ ID NO:1544); miR-6077-1 (SEQ ID NO:1543); miR-6078 (SEQ ID NO:1545); miR-6079 (SEQ ID NO:1546); miR-6080 (SEQ ID NO:1547); miR-6081 (SEQ ID NO:1548); miR-6082 (SEQ ID NO:1549); miR-6083 (SEQ ID NO:1550); miR-6084 (SEQ ID NO:1551); miR-6085 (SEQ ID NO:1552); miR-6086 (SEQ ID NO:1553); miR-6087 (SEQ ID NO:1554); miR-6088 (SEQ ID NO:1555); miR-6089-2 (SEQ ID NO:1557); miR-6089-1 (SEQ ID NO:1556); miR-6090 (SEQ ID NO:1558); miR-6124 (SEQ ID NO:1559); miR-6125 (SEQ ID NO:1560); miR-6126 (SEQ ID NO:1561); miR-6127 (SEQ ID NO:1562); miR-6128 (SEQ ID NO:1563); miR-6129 (SEQ ID NO:1564); miR-6130 (SEQ ID NO:1565); miR-6131 (SEQ ID NO:1566); miR-6132 (SEQ ID NO:1567); miR-6133 (SEQ ID NO:1568); miR-6134 (SEQ ID NO:1569); miR-6165 (SEQ ID NO:1570); miR-6499 (SEQ ID NO:1571); miR-6500 (SEQ ID NO:1572); miR-6501 (SEQ ID NO:1573); miR-6502 (SEQ ID NO:1574); miR-6503 (SEQ ID NO:1575); miR-6504 (SEQ ID NO:1576); miR-6505 (SEQ ID NO:1577); miR-6506 (SEQ ID NO:1578); miR-6507 (SEQ ID NO:1579); miR-6508 (SEQ ID NO:1580); miR-6509 (SEQ ID NO:1581); miR-6510 (SEQ ID NO:1582); miR-6511a-1 (SEQ ID NO:1583); miR-6511a-2 (SEQ ID NO:1584); miR-6511a-3 (SEQ ID NO:1585); miR-6511a-4 (SEQ ID NO:1586); miR-6511b-1 (SEQ ID NO:1587); miR-6511b-2 (SEQ ID NO:1588); miR-6512 (SEQ ID NO:1589); miR-6513 (SEQ ID NO:1590); miR-6514 (SEQ ID NO:1591); miR-6515 (SEQ ID NO:1592); miR-6516 (SEQ ID NO:1593); miR-6715a (SEQ ID NO:1594); miR-6715b (SEQ ID NO:1595); miR-6716 (SEQ ID NO:1596); miR-6717 (SEQ ID NO:1597); miR-6718 (SEQ ID NO:1598); miR-6719 (SEQ ID NO:1599); miR-6720 (SEQ ID NO:1600); miR-6721 (SEQ ID NO:1601); miR-6722 (SEQ ID NO:1602); miR-6723 (SEQ ID NO:1603); miR-6724 (SEQ ID NO:1604); miR-6726 (SEQ ID NO:1605); miR-6727 (SEQ ID NO:1606); miR-6728 (SEQ ID NO:1607); miR-6729 (SEQ ID NO:1608); miR-6730 (SEQ ID NO:1609); miR-6731 (SEQ ID NO:1610); miR-6732 (SEQ ID NO:1611); miR-6733 (SEQ ID NO:1612); miR-6734 (SEQ ID NO:1613); miR-6735 (SEQ ID NO:1614); miR-6736 (SEQ ID NO:1615); miR-6737 (SEQ ID NO:1616); miR-6738 (SEQ ID NO:1617); miR-6739 (SEQ ID NO:1618); miR-6740 (SEQ ID NO:1619); miR-6741 (SEQ ID NO:1620); miR-6742 (SEQ ID NO:1621); miR-6743 (SEQ ID NO:1622); miR-6744 (SEQ ID NO:1623); miR-6745 (SEQ ID NO:1624); miR-6746 (SEQ ID NO:1625);

miR-6747 (SEQ ID NO:1626); miR-6748 (SEQ ID NO:1627); miR-6749 (SEQ ID NO:1628); miR-6750 (SEQ ID NO:1629); miR-6751 (SEQ ID NO:1630); miR-6752 (SEQ ID NO:1631); miR-6753 (SEQ ID NO:1632); miR-6754 (SEQ ID NO:1633); miR-6755 (SEQ ID NO:1634); miR-6756 (SEQ ID NO:1635); miR-6757 (SEQ ID NO:1636); miR-6758 (SEQ ID NO:1637); miR-6759 (SEQ ID NO:1638); miR-6760 (SEQ ID NO:1639); miR-6761 (SEQ ID NO:1640); miR-6762 (SEQ ID NO:1641); miR-6763 (SEQ ID NO:1642); miR-6764 (SEQ ID NO:1643); miR-6765 (SEQ ID NO:1644); miR-6766 (SEQ ID NO:1645); miR-6767 (SEQ ID NO:1646); miR-6768 (SEQ ID NO:1647); miR-6769a (SEQ ID NO:1648); miR-6769b (SEQ ID NO:1649); miR-6770-3 (SEQ ID NO:1652); miR-6770-2 (SEQ ID NO:1651); miR-6770-1 (SEQ ID NO:1650); miR-6771 (SEQ ID NO:1653); miR-6772 (SEQ ID NO:1654); miR-6773 (SEQ ID NO:1655); miR-6774 (SEQ ID NO:1656); miR-6775 (SEQ ID NO:1657); miR-6776 (SEQ ID NO:1658); miR-6777 (SEQ ID NO:1659); miR-6778 (SEQ ID NO:1660); miR-6779 (SEQ ID NO:1661); miR-6780a (SEQ ID NO:1662); miR-6780b (SEQ ID NO:1663); miR-6781 (SEQ ID NO:1664); miR-6782 (SEQ ID NO:1665); miR-6783 (SEQ ID NO:1666); miR-6784 (SEQ ID NO:1667); miR-6785 (SEQ ID NO:1668); miR-6786 (SEQ ID NO:1669); miR-6787 (SEQ ID NO:1670); miR-6788 (SEQ ID NO:1671); miR-6789 (SEQ ID NO:1672); miR-6790 (SEQ ID NO:1673); miR-6791 (SEQ ID NO:1674); miR-6792 (SEQ ID NO:1675); miR-6793 (SEQ ID NO:1676); miR-6794 (SEQ ID NO:1677); miR-6795 (SEQ ID NO:1678); miR-6796 (SEQ ID NO:1679); miR-6797 (SEQ ID NO:1680); miR-6798 (SEQ ID NO:1681); miR-6799 (SEQ ID NO:1682); miR-6800 (SEQ ID NO:1683); miR-6801 (SEQ ID NO:1684); miR-6802 (SEQ ID NO:1685); miR-6803 (SEQ ID NO:1686); miR-6804 (SEQ ID NO:1687); miR-6805 (SEQ ID NO:1688); miR-6806 (SEQ ID NO:1689); miR-6807 (SEQ ID NO:1690); miR-6808 (SEQ ID NO:1691); miR-6809 (SEQ ID NO:1692); miR-6810 (SEQ ID NO:1693); miR-6811 (SEQ ID NO:1694); miR-6812 (SEQ ID NO:1695); miR-6813 (SEQ ID NO:1696); miR-6814 (SEQ ID NO:1697); miR-6815 (SEQ ID NO:1698); miR-6816 (SEQ ID NO:1699); miR-6817 (SEQ ID NO:1700); miR-6818 (SEQ ID NO:1701); miR-6819 (SEQ ID NO:1702); miR-6820 (SEQ ID NO:1703); miR-6821 (SEQ ID NO:1704); miR-6822 (SEQ ID NO:1705); miR-6823 (SEQ ID NO:1706); miR-6824 (SEQ ID NO:1707); miR-6825 (SEQ ID NO:1708); miR-6826 (SEQ ID NO:1709); miR-6827 (SEQ ID NO:1710); miR-6828 (SEQ ID NO:1711); miR-6829 (SEQ ID NO:1712); miR-6830 (SEQ ID NO:1713); miR-6831 (SEQ ID NO:1714); miR-6832 (SEQ ID NO:1715); miR-6833 (SEQ ID NO:1716); miR-6834 (SEQ ID NO:1717); miR-6835 (SEQ ID NO:1718); miR-6836 (SEQ ID NO:1719); miR-6837 (SEQ ID NO:1720); miR-6838 (SEQ ID NO:1721); miR-6839 (SEQ ID NO:1722); miR-6840 (SEQ ID NO:1723); miR-6841 (SEQ ID NO:1724); miR-6842 (SEQ ID NO:1725); miR-6843 (SEQ ID NO:1726); miR-6844 (SEQ ID NO:1727); miR-6845 (SEQ ID NO:1728); miR-6846 (SEQ ID NO:1729); miR-6847 (SEQ ID NO:1730); miR-6848 (SEQ ID NO:1731); miR-6849 (SEQ ID NO:1732); miR-6850 (SEQ ID NO:1733); miR-6851 (SEQ ID NO:1734); miR-6852 (SEQ ID NO:1735); miR-6853 (SEQ ID NO:1736); miR-6854 (SEQ ID NO:1737); miR-6855 (SEQ ID NO:1738); miR-6856 (SEQ ID NO:1739); miR-6857 (SEQ ID NO:1740); miR-6858 (SEQ ID NO:1741); miR-6859-3 (SEQ ID NO:1744); miR-6859-2 (SEQ ID NO:1743); miR-6859-1 (SEQ ID NO:1742); miR-6860 (SEQ ID NO:1745); miR-6861 (SEQ ID NO:1746); miR-6862-2 (SEQ ID NO:1748); miR-6862-1 (SEQ ID NO:1747); miR-6863 (SEQ ID NO:1749); miR-6864 (SEQ ID NO:1750); miR-6865 (SEQ ID NO:1751); miR-6866 (SEQ ID NO:1752); miR-6867 (SEQ ID NO:1753); miR-6868 (SEQ ID NO:1754); miR-6869 (SEQ ID NO:1755); miR-6870 (SEQ ID NO:1756); miR-6871 (SEQ ID NO:1757); miR-6872 (SEQ ID NO:1758); miR-6873 (SEQ ID NO:1759); miR-6874 (SEQ ID NO:1760); miR-6875 (SEQ ID NO:1761); miR-6876 (SEQ ID NO:1762); miR-6877 (SEQ ID NO:1763); miR-6878 (SEQ ID NO:1764); miR-6879 (SEQ ID NO:1765); miR-6880 (SEQ ID NO:1766); miR-6881 (SEQ ID NO:1767); miR-6882 (SEQ ID NO:1768); miR-6883 (SEQ ID NO:1769); miR-6884 (SEQ ID NO:1770); miR-6885 (SEQ ID NO:1771); miR-6886 (SEQ ID NO:1772); miR-6887 (SEQ ID NO:1773); miR-6888 (SEQ ID NO:1774); miR-6889 (SEQ ID NO:1775); miR-6890 (SEQ ID NO:1776); miR-6891 (SEQ ID NO:1777); miR-6892 (SEQ ID NO:1778); miR-6893 (SEQ ID NO:1779); miR-6894 (SEQ ID NO:1780); miR-6895 (SEQ ID NO:1781); miR-7106 (SEQ ID NO:1782); miR-7107 (SEQ ID NO:1783); miR-7108 (SEQ ID NO:1784); miR-7109 (SEQ ID NO:1785); miR-7110 (SEQ ID NO:1786); miR-7111 (SEQ ID NO:1787); miR-7112-2 (SEQ ID NO:1789); miR-7112-1 (SEQ ID NO:1788); miR-7113 (SEQ ID NO:1790); miR-7114 (SEQ ID NO:1791); miR-7150 (SEQ ID NO:1792); miR-7151 (SEQ ID NO:1793); miR-7152 (SEQ ID NO:1794); miR-7153 (SEQ ID NO:1795); miR-7154 (SEQ ID NO:1796); miR-7155 (SEQ ID NO:1797); miR-7156 (SEQ ID NO:1798); miR-7157 (SEQ ID NO:1799); miR-7158 (SEQ ID NO:1800); miR-7159 (SEQ ID NO:1801); miR-7160 (SEQ ID NO:1802); miR-7161 (SEQ ID NO:1803); miR-7162 (SEQ ID NO:1804); miR-7515 (SEQ ID NO:1805); miR-7641-2 (SEQ ID NO:1807); miR-7641-1 (SEQ ID NO:1806); miR-7702 (SEQ ID NO:1808); miR-7703 (SEQ ID NO:1809); miR-7704 (SEQ ID NO:1810); miR-7705 (SEQ ID NO:1811); miR-7706 (SEQ ID NO:1812); miR-7843 (SEQ ID NO:1813); miR-7844 (SEQ ID NO:1814); miR-7845 (SEQ ID NO:1815); miR-7846 (SEQ ID NO:1816); miR-7847 (SEQ ID NO:1817); miR-7848 (SEQ ID NO:1818); miR-7849 (SEQ ID NO:1819); miR-7850 (SEQ ID NO:1820); miR-7851 (SEQ ID NO:1821); miR-7852 (SEQ ID NO:1822); miR-7853 (SEQ ID NO:1823); miR-7854 (SEQ ID NO:1824); miR-7855 (SEQ ID NO:1825); miR-7856 (SEQ ID NO:1826); miR-7973-2 (SEQ ID NO:1828); miR-7973-1 (SEQ ID NO:1827); miR-7974 (SEQ ID NO:1829); miR-7975 (SEQ ID NO:1830); miR-7976 (SEQ ID NO:1831); miR-7977 (SEQ ID NO:1832); miR-7978 (SEQ ID NO:1833); miR-8052 (SEQ ID NO:1834); miR-8053 (SEQ ID NO:1835); miR-8054 (SEQ ID NO:1836); miR-8055 (SEQ ID NO:1837); miR-8056 (SEQ ID NO:1838); miR-8057 (SEQ ID NO:1839); miR-8058 (SEQ ID NO:1840); miR-8059 (SEQ ID NO:1841); miR-8060 (SEQ ID NO:1842); miR-8061 (SEQ ID NO:1843); miR-8062 (SEQ ID NO:1844); miR-8063 (SEQ ID NO:1845); miR-8064 (SEQ ID NO:1846); miR-8065 (SEQ ID NO:1847); miR-8066 (SEQ ID NO:1848); miR-8067 (SEQ ID NO:1849); miR-8068 (SEQ ID NO:1850); miR-8069 (SEQ ID NO:1851); miR-8070 (SEQ ID NO:1852); miR-8071-2 (SEQ ID NO:1854); miR-8071-1 (SEQ ID NO:1853); miR-8072 (SEQ ID NO:1855); miR-8073 (SEQ ID NO:1856); miR-8074 (SEQ ID NO:1857); miR-8075 (SEQ ID NO:1858); miR-8076 (SEQ ID NO:1859); miR-8077 (SEQ ID NO:1860); miR-8078 (SEQ ID NO:1861); miR-8079 (SEQ ID NO:1862); miR-8080 (SEQ ID NO:1863); miR-8081 (SEQ ID NO:1864); miR-8082 (SEQ ID NO:1865); miR-8083 (SEQ ID NO:1866);

miR-8084 (SEQ ID NO:1867); miR-8085 (SEQ ID NO:1868); miR-8086 (SEQ ID NO:1869); miR-8087 (SEQ ID NO:1870); miR-8088 (SEQ ID NO:1871); and miR-8089 (SEQ ID NO:1872).

The following dog miRNA could be used: let-7a-1 (SEQ ID NO:2744); let-7a-2 (SEQ ID NO:2745); let-7b (SEQ ID NO:2746); let-7c (SEQ ID NO:2747); let-7e (SEQ ID NO:2748); let-7f (SEQ ID NO:2749); let-7g (SEQ ID NO:2750); let-7j (SEQ ID NO:2751); miR-1-1 (SEQ ID NO:2752); miR-1-2 (SEQ ID NO:2753); miR-7-1 (SEQ ID NO:2754); miR-7-2 (SEQ ID NO:2755); miR-7-3 (SEQ ID NO:2756); miR-9-1 (SEQ ID NO:2757); miR-9-2 (SEQ ID NO:2758); miR-9-3 (SEQ ID NO:2759); miR-10a (SEQ ID NO:2760); miR-10b (SEQ ID NO:2761); miR-15a (SEQ ID NO:2762); miR-15b (SEQ ID NO:2763); miR-16-1 (SEQ ID NO:2764); miR-16-2 (SEQ ID NO:2765); miR-17 (SEQ ID NO:2766); miR-18a (SEQ ID NO:2767); miR-18b (SEQ ID NO:2768); miR-19a (SEQ ID NO:2769); miR-19b-1 (SEQ ID NO:2770); miR-19b-2 (SEQ ID NO:2771); miR-20a (SEQ ID NO:2772); miR-20b (SEQ ID NO:2773); miR-21 (SEQ ID NO:2774); miR-22 (SEQ ID NO:2775); miR-23a (SEQ ID NO:2776); miR-23b (SEQ ID NO:2777); miR-24-1 (SEQ ID NO:2778); miR-24-2 (SEQ ID NO:2779); miR-25 (SEQ ID NO:2780); miR-26a-1 (SEQ ID NO:2781); miR-26a-2 (SEQ ID NO:2782); miR-26b (SEQ ID NO:2783); miR-27a (SEQ ID NO:2784); miR-27b (SEQ ID NO:2785); miR-28 (SEQ ID NO:2786); miR-29a (SEQ ID NO:2787); miR-29b-1 (SEQ ID NO:2788); miR-29b-2 (SEQ ID NO:2789); miR-29c-1 (SEQ ID NO:2790); miR-29c-2 (SEQ ID NO:2791); miR-30a (SEQ ID NO:2792); miR-30b (SEQ ID NO:2793); miR-30c-1 (SEQ ID NO:2794); miR-30c-2 (SEQ ID NO:2795); miR-30d (SEQ ID NO:2796); miR-30e (SEQ ID NO:2797); miR-31 (SEQ ID NO:2798); miR-32 (SEQ ID NO:2799); miR-33a (SEQ ID NO:2800); miR-33b (SEQ ID NO:2801); miR-34a (SEQ ID NO:2802); miR-34b (SEQ ID NO:2803); miR-34c (SEQ ID NO:2804); miR-92a-1 (SEQ ID NO:2805); miR-92a-2 (SEQ ID NO:2806); miR-92b (SEQ ID NO:2807); miR-93 (SEQ ID NO:2808); miR-95 (SEQ ID NO:2809); miR-96 (SEQ ID NO:2810); miR-98 (SEQ ID NO:2811); miR-99a-1 (SEQ ID NO:2812); miR-99a-2 (SEQ ID NO:2813); miR-99b (SEQ ID NO:2814); miR-101-1 (SEQ ID NO:2815); miR-101-2 (SEQ ID NO:2816); miR-103-1 (SEQ ID NO:2817); miR-103-2 (SEQ ID NO:2818); miR-105a (SEQ ID NO:2819); miR-105b (SEQ ID NO:2820); miR-106a (SEQ ID NO:2821); miR-106b (SEQ ID NO:2822); miR-107 (SEQ ID NO:2823); miR-122 (SEQ ID NO:2824); miR-124-1 (SEQ ID NO:2825); miR-124-2 (SEQ ID NO:2826); miR-124-3 (SEQ ID NO:2827); miR-125a (SEQ ID NO:2828); miR-125b-1 (SEQ ID NO:2829); miR-125b-2 (SEQ ID NO:2830); miR-126 (SEQ ID NO:2831); miR-127 (SEQ ID NO:2832); miR-128-1 (SEQ ID NO:2833); miR-128-2 (SEQ ID NO:2834); miR-129-1 (SEQ ID NO:2835); miR-129-2 (SEQ ID NO:2836); miR-130a (SEQ ID NO:2837); miR-130b (SEQ ID NO:2838); miR-132 (SEQ ID NO:2839); miR-133a (SEQ ID NO:2840); miR-133b (SEQ ID NO:2841); miR-133c (SEQ ID NO:2842); miR-134 (SEQ ID NO:2843); miR-135a-1 (SEQ ID NO:2844); miR-135a-2 (SEQ ID NO:2845); miR-135b (SEQ ID NO:2846); miR-136 (SEQ ID NO:2847); miR-137 (SEQ ID NO:2848); miR-138a (SEQ ID NO:2849); miR-138b (SEQ ID NO:2850); miR-139 (SEQ ID NO:2851); miR-140 (SEQ ID NO:2852); miR-141 (SEQ ID NO:2853); miR-142 (SEQ ID NO:2854); miR-143 (SEQ ID NO:2855); miR-144 (SEQ ID NO:2856); miR-145 (SEQ ID NO:2857); miR-146a (SEQ ID NO:2858); miR-146b (SEQ ID NO:2859); miR-147 (SEQ ID NO:2860); miR-148a (SEQ ID NO:2861); miR-148b (SEQ ID NO:2862); miR-149 (SEQ ID NO:2863); miR-150 (SEQ ID NO:2864); miR-151 (SEQ ID NO:2865); miR-152 (SEQ ID NO:2866); miR-153 (SEQ ID NO:2867); miR-155 (SEQ ID NO:2868); miR-181a-1 (SEQ ID NO:2869); miR-181a-2 (SEQ ID NO:2870); miR-181b-1 (SEQ ID NO:2871); miR-181b-2 (SEQ ID NO:2872); miR-181c (SEQ ID NO:2873); miR-181d (SEQ ID NO:2874); miR-182 (SEQ ID NO:2875); miR-183 (SEQ ID NO:2876); miR-184 (SEQ ID NO:2877); miR-185 (SEQ ID NO:2878); miR-186 (SEQ ID NO:2879); miR-187 (SEQ ID NO:2880); miR-188 (SEQ ID NO:2881); miR-190a (SEQ ID NO:2882); miR-190b (SEQ ID NO:2883); miR-191 (SEQ ID NO:2884); miR-192 (SEQ ID NO:2885); miR-193a (SEQ ID NO:2886); miR-193b (SEQ ID NO:2887); miR-194 (SEQ ID NO:2888); miR-195 (SEQ ID NO:2889); miR-196a-1 (SEQ ID NO:2890); miR-196a-2 (SEQ ID NO:2891); miR-196b (SEQ ID NO:2892); miR-197 (SEQ ID NO:2893); miR-199-1 (SEQ ID NO:2894); miR-199-2 (SEQ ID NO:2895); miR-199-3 (SEQ ID NO:2896); miR-200a (SEQ ID NO:2897); miR-200b (SEQ ID NO:2898); miR-200c (SEQ ID NO:2899); miR-202 (SEQ ID NO:2900); miR-203 (SEQ ID NO:2901); miR-204 (SEQ ID NO:2902); miR-205 (SEQ ID NO:2903); miR-206 (SEQ ID NO:2904); miR-207 (SEQ ID NO:2905); miR-208a (SEQ ID NO:2906); miR-208b (SEQ ID NO:2907); miR-210 (SEQ ID NO:2908); miR-211 (SEQ ID NO:2909); miR-212 (SEQ ID NO:2910); miR-214 (SEQ ID NO:2911); miR-215 (SEQ ID NO:2912); miR-216a (SEQ ID NO:2913); miR-216b (SEQ ID NO:2914); miR-217 (SEQ ID NO:2915); miR-218-1 (SEQ ID NO:2916); miR-218-2 (SEQ ID NO:2917); miR-219-1 (SEQ ID NO:2918); miR-219-2 (SEQ ID NO:2919); miR-221 (SEQ ID NO:2920); miR-222 (SEQ ID NO:2921); miR-223 (SEQ ID NO:2922); miR-224 (SEQ ID NO:2923); miR-299 (SEQ ID NO:2924); miR-300 (SEQ ID NO:2925); miR-301a (SEQ ID NO:2926); miR-301b (SEQ ID NO:2927); miR-302a (SEQ ID NO:2928); miR-302b (SEQ ID NO:2929); miR-302c (SEQ ID NO:2930); miR-302d (SEQ ID NO:2931); miR-320 (SEQ ID NO:2932); miR-323 (SEQ ID NO:2933); miR-324 (SEQ ID NO:2934); miR-325 (SEQ ID NO:2935); miR-326 (SEQ ID NO:2936); miR-328 (SEQ ID NO:2937); miR-329a (SEQ ID NO:2938); miR-329b (SEQ ID NO:2939); miR-330 (SEQ ID NO:2940); miR-331 (SEQ ID NO:2941); miR-335 (SEQ ID NO:2942); miR-338 (SEQ ID NO:2943); miR-340 (SEQ ID NO:2944); miR-342 (SEQ ID NO:2945); miR-345 (SEQ ID NO:2946); miR-346 (SEQ ID NO:2947); miR-350 (SEQ ID NO:2948); miR-361 (SEQ ID NO:2949); miR-362 (SEQ ID NO:2950); miR-363 (SEQ ID NO:2951); miR-365-1 (SEQ ID NO:2952); miR-365-2 (SEQ ID NO:2953); miR-367 (SEQ ID NO:2954); miR-369 (SEQ ID NO:2955); miR-370 (SEQ ID NO:2956); miR-371 (SEQ ID NO:2957); miR-374a (SEQ ID NO:2958); miR-374b (SEQ ID NO:2959); miR-375 (SEQ ID NO:2960); miR-376a-1 (SEQ ID NO:2961); miR-376a-2 (SEQ ID NO:2962); miR-376a-3 (SEQ ID NO:2963); miR-376b (SEQ ID NO:2964); miR-376c (SEQ ID NO:2965); miR-377 (SEQ ID NO:2966); miR-378 (SEQ ID NO:2967); miR-379 (SEQ ID NO:2968); miR-380 (SEQ ID NO:2969); miR-381 (SEQ ID NO:2970); miR-382 (SEQ ID NO:2971); miR-383 (SEQ ID NO:2972); miR-384 (SEQ ID NO:2973); miR-409 (SEQ ID NO:2974); miR-410 (SEQ ID NO:2975); miR-411 (SEQ ID NO:2976); miR-421 (SEQ ID NO:2977); miR-423a (SEQ ID NO:2978); miR-424 (SEQ ID NO:2979); miR-425 (SEQ ID NO:2980); miR-429 (SEQ ID NO:2981); miR-432 (SEQ ID NO:2982); miR-433 (SEQ ID NO:2983); miR-448 (SEQ ID NO:2984); miR-449 (SEQ ID NO:2985); miR-450a (SEQ ID NO:2986); miR-450b (SEQ ID NO:2987); miR-451 (SEQ ID NO:2988); miR-452 (SEQ ID NO:2989); miR-454 (SEQ ID NO:2990); miR-455 (SEQ ID NO:2991); miR-483 (SEQ ID NO:2992);

miR-485 (SEQ ID NO:2993); miR-487a (SEQ ID NO:2994); miR-487b (SEQ ID NO:2995); miR-488 (SEQ ID NO:2996); miR-489 (SEQ ID NO:2997); miR-490 (SEQ ID NO:2998); miR-491 (SEQ ID NO:2999); miR-493 (SEQ ID NO:3000); miR-494 (SEQ ID NO:3001); miR-495 (SEQ ID NO:3002); miR-496 (SEQ ID NO:3003); miR-497 (SEQ ID NO:3004); miR-499 (SEQ ID NO:3005); miR-500 (SEQ ID NO:3006); miR-502 (SEQ ID NO:3007); miR-503 (SEQ ID NO:3008); miR-504 (SEQ ID NO:3009); miR-505 (SEQ ID NO:3010); miR-514 (SEQ ID NO:3011); miR-532 (SEQ ID NO:3012); miR-539 (SEQ ID NO:3013); miR-542 (SEQ ID NO:3014); miR-543 (SEQ ID NO:3015); miR-544 (SEQ ID NO:3016); miR-545 (SEQ ID NO:3017); miR-551a (SEQ ID NO:3018); miR-551b (SEQ ID NO:3019); miR-568 (SEQ ID NO:3020); miR-574 (SEQ ID NO:3021); miR-578 (SEQ ID NO:3022); miR-582 (SEQ ID NO:3023); miR-589 (SEQ ID NO:3024); miR-590 (SEQ ID NO:3025); miR-592 (SEQ ID NO:3026); miR-599 (SEQ ID NO:3027); miR-615 (SEQ ID NO:3028); miR-628 (SEQ ID NO:3029); miR-631 (SEQ ID NO:3030); miR-632 (SEQ ID NO:3031); miR-652 (SEQ ID NO:3032); miR-653 (SEQ ID NO:3033); miR-660 (SEQ ID NO:3034); miR-664 (SEQ ID NO:3035); miR-665 (SEQ ID NO:3036); miR-671 (SEQ ID NO:3037); miR-676 (SEQ ID NO:3038); miR-708 (SEQ ID NO:3039); miR-718 (SEQ ID NO:3040); miR-758 (SEQ ID NO:3041); miR-759 (SEQ ID NO:3042); miR-761 (SEQ ID NO:3043); miR-764 (SEQ ID NO:3044); miR-802 (SEQ ID NO:3045); miR-872 (SEQ ID NO:3046); miR-874 (SEQ ID NO:3047); miR-875 (SEQ ID NO:3048); miR-876 (SEQ ID NO:3049); miR-885 (SEQ ID NO:3050); miR-1199 (SEQ ID NO:3051); miR-1271 (SEQ ID NO:3052); miR-1306 (SEQ ID NO:3053); miR-1307 (SEQ ID NO:3054); miR-1835 (SEQ ID NO:3055); miR-1836 (SEQ ID NO:3056); miR-1837-1 (SEQ ID NO:3057); miR-1837-2 (SEQ ID NO:3058); miR-1837-3 (SEQ ID NO:3059); miR-1837-4 (SEQ ID NO:3060); miR-1838 (SEQ ID NO:3061); miR-1839 (SEQ ID NO:3062); miR-1840 (SEQ ID NO:3063); miR-1841 (SEQ ID NO:3064); miR-1842 (SEQ ID NO:3065); miR-1843 (SEQ ID NO:3066); and miR-1844 (SEQ ID NO:3067).

The following horse miRNAs could be used: let-7a (SEQ ID NO:3068); let-7a-2 (SEQ ID NO:3069); let-7c (SEQ ID NO:3070); let-7d (SEQ ID NO:3071); let-7e (SEQ ID NO:3072); let-7f (SEQ ID NO:3073); let-7g (SEQ ID NO:3074); miR-1-1 (SEQ ID NO:3075); miR-1-2 (SEQ ID NO:3076); miR-7-1 (SEQ ID NO:3077); miR-7-2 (SEQ ID NO:3078); miR-7-3 (SEQ ID NO:3079); miR-9a (SEQ ID NO:3080); miR-9a-2 (SEQ ID NO:3081); miR-10a (SEQ ID NO:3082); miR-10b (SEQ ID NO:3083); miR-15a (SEQ ID NO:3084); miR-15b (SEQ ID NO:3085); miR-16-1 (SEQ ID NO:3086); miR-16-2 (SEQ ID NO:3087); miR-17 (SEQ ID NO:3088); miR-18a (SEQ ID NO:3089); miR-18b (SEQ ID NO:3090); miR-19a (SEQ ID NO:3091); miR-19b (SEQ ID NO:3092); miR-19b-2 (SEQ ID NO:3093); miR-20a (SEQ ID NO:3094); miR-20b (SEQ ID NO:3095); miR-21 (SEQ ID NO:3096); miR-22 (SEQ ID NO:3097); miR-23a (SEQ ID NO:3098); miR-23b (SEQ ID NO:3099); miR-24-1 (SEQ ID NO:3100); miR-24-2 (SEQ ID NO:3101); miR-25 (SEQ ID NO:3102); miR-26a (SEQ ID NO:3103); miR-26a-2 (SEQ ID NO:3104); miR-27a (SEQ ID NO:3105); miR-27b (SEQ ID NO:3106); miR-28 (SEQ ID NO:3107); miR-29a (SEQ ID NO:3108); miR-29b (SEQ ID NO:3109); miR-29b-2 (SEQ ID NO:3110); miR-29c (SEQ ID NO:3111); miR-29c-2 (SEQ ID NO:3112); miR-30b (SEQ ID NO:3113); miR-30c (SEQ ID NO:3114); miR-30c-2 (SEQ ID NO:3115); miR-30d (SEQ ID NO:3116); miR-30e (SEQ ID NO:3117); miR-31 (SEQ ID NO:3118); miR-32 (SEQ ID NO:3119); miR-33a (SEQ ID NO:3120); miR-33b (SEQ ID NO:3121); miR-34a (SEQ ID NO:3122); miR-34b (SEQ ID NO:3123); miR-34c (SEQ ID NO:3124); miR-92a (SEQ ID NO:3125); miR-92a-2 (SEQ ID NO:3126); miR-92b (SEQ ID NO:3127); miR-93 (SEQ ID NO:3128); miR-95 (SEQ ID NO:3129); miR-96 (SEQ ID NO:3130); miR-98 (SEQ ID NO:3131); miR-99a-2 (SEQ ID NO:3132); miR-99b (SEQ ID NO:3133); miR-100 (SEQ ID NO:3134); miR-101-1 (SEQ ID NO:3135); miR-101-2 (SEQ ID NO:3136); miR-103 (SEQ ID NO:3137); miR-105 (SEQ ID NO:3138); miR-106a (SEQ ID NO:3139); miR-106b (SEQ ID NO:3140); miR-107a (SEQ ID NO:3141); miR-107b (SEQ ID NO:3142); miR-122 (SEQ ID NO:3143); miR-124-1 (SEQ ID NO:3144); miR-124-2 (SEQ ID NO:3145); miR-125a (SEQ ID NO:3146); miR-125b (SEQ ID NO:3147); miR-125b-2 (SEQ ID NO:3148); miR-126 (SEQ ID NO:3149); miR-127 (SEQ ID NO:3150); miR-128-1 (SEQ ID NO:3151); miR-128-2 (SEQ ID NO:3152); miR-129a (SEQ ID NO:3153); miR-129b (SEQ ID NO:3154); miR-130a (SEQ ID NO:3155); miR-130b (SEQ ID NO:3156); miR-132 (SEQ ID NO:3157); miR-133a (SEQ ID NO:3158); miR-133a-2 (SEQ ID NO:3159); miR-133b (SEQ ID NO:3160); miR-134 (SEQ ID NO:3161); miR-135a (SEQ ID NO:3162); miR-135a-2 (SEQ ID NO:3163); miR-135b (SEQ ID NO:3164); miR-136 (SEQ ID NO:3165); miR-137 (SEQ ID NO:3166); miR-138-1 (SEQ ID NO:3167); miR-138-2 (SEQ ID NO:3168); miR-139 (SEQ ID NO:3169); miR-140 (SEQ ID NO:3170); miR-141 (SEQ ID NO:3171); miR-142 (SEQ ID NO:3172); miR-143 (SEQ ID NO:3173); miR-144 (SEQ ID NO:3174); miR-145 (SEQ ID NO:3175); miR-146a (SEQ ID NO:3176); miR-146b (SEQ ID NO:3177); miR-147b (SEQ ID NO:3178); miR-148a (SEQ ID NO:3179); miR-148b (SEQ ID NO:3180); miR-149 (SEQ ID NO:3181); miR-150 (SEQ ID NO:3182); miR-151 (SEQ ID NO:3183); miR-153-1 (SEQ ID NO:3184); miR-153-2 (SEQ ID NO:3185); miR-154 (SEQ ID NO:3186); miR-155 (SEQ ID NO:3187); miR-181a (SEQ ID NO:3188); miR-181a-2 (SEQ ID NO:3189); miR-181b (SEQ ID NO:3190); miR-182 (SEQ ID NO:3191); miR-183 (SEQ ID NO:3192); miR-184 (SEQ ID NO:3193); miR-186 (SEQ ID NO:3194); miR-187 (SEQ ID NO:3195); miR-188 (SEQ ID NO:3196); miR-190a (SEQ ID NO:3197); miR-190b (SEQ ID NO:3198); miR-191 (SEQ ID NO:3199); miR-192 (SEQ ID NO:3200); miR-193a (SEQ ID NO:3201); miR-193b (SEQ ID NO:3202); miR-194-1 (SEQ ID NO:3203); miR-194-2 (SEQ ID NO:3204); miR-195 (SEQ ID NO:3205); miR-196a (SEQ ID NO:3206); miR-196b (SEQ ID NO:3207); miR-197 (SEQ ID NO:3208); miR-199a (SEQ ID NO:3209); miR-199b (SEQ ID NO:3210); miR-200a (SEQ ID NO:3211); miR-200b (SEQ ID NO:3212); miR-200c (SEQ ID NO:3213); miR-204b-2 (SEQ ID NO:3214); miR-205 (SEQ ID NO:3215); miR-206-2 (SEQ ID NO:3216); miR-208a (SEQ ID NO:3217); miR-208b (SEQ ID NO:3218); miR-211 (SEQ ID NO:3219); miR-212 (SEQ ID NO:3220); miR-214 (SEQ ID NO:3221); miR-215 (SEQ ID NO:3222); miR-216a (SEQ ID NO:3223); miR-216b (SEQ ID NO:3224); miR-217 (SEQ ID NO:3225); miR-218-1 (SEQ ID NO:3226); miR-218-2 (SEQ ID NO:3227); miR-219-1 (SEQ ID NO:3228); miR-219-2 (SEQ ID NO:3229); miR-221 (SEQ ID NO:3230); miR-222 (SEQ ID NO:3231); miR-223 (SEQ ID NO:3232); miR-224 (SEQ ID NO:3233); miR-296 (SEQ ID NO:3234); miR-299 (SEQ ID NO:3235); miR-301a (SEQ ID NO:3236); miR-301b (SEQ ID NO:3237); miR-302a (SEQ ID NO:3238); miR-302b (SEQ ID NO:3239); miR-302c (SEQ ID NO:3240); miR-302d (SEQ ID NO:3241); miR-323 (SEQ ID NO:3242); miR-324 (SEQ ID NO:3243); miR-326 (SEQ ID NO:3244); miR-328 (SEQ ID NO:3245); miR-329 (SEQ ID NO:3246); miR-330 (SEQ ID NO:3247); miR-331 (SEQ ID NO:3248);

miR-335 (SEQ ID NO:3249); miR-337 (SEQ ID NO:3250); miR-338 (SEQ ID NO:3251); miR-340 (SEQ ID NO:3252); miR-342 (SEQ ID NO:3253); miR-345 (SEQ ID NO:3254); miR-346 (SEQ ID NO:3255); miR-350 (SEQ ID NO:3256); miR-361 (SEQ ID NO:3257); miR-362 (SEQ ID NO:3258); miR-363 (SEQ ID NO:3259); miR-365-1 (SEQ ID NO:3260); miR-365-2 (SEQ ID NO:3261); miR-367 (SEQ ID NO:3262); miR-369 (SEQ ID NO:3263); miR-370 (SEQ ID NO:3264); miR-371 (SEQ ID NO:3265); miR-374a (SEQ ID NO:3266); miR-374b (SEQ ID NO:3267); miR-376a (SEQ ID NO:3268); miR-376b (SEQ ID NO:3269); miR-376c (SEQ ID NO:3270); miR-377 (SEQ ID NO:3271); miR-378 (SEQ ID NO:3272); miR-379 (SEQ ID NO:3273); miR-380 (SEQ ID NO:3274); miR-381 (SEQ ID NO:3275); miR-382 (SEQ ID NO:3276); miR-383 (SEQ ID NO:3277); miR-384 (SEQ ID NO:3278); miR-409 (SEQ ID NO:3279); miR-410 (SEQ ID NO:3280); miR-411 (SEQ ID NO:3281); miR-412 (SEQ ID NO:3282); miR-421 (SEQ ID NO:3283); miR-423 (SEQ ID NO:3284); miR-424 (SEQ ID NO:3285); miR-429 (SEQ ID NO:3286); miR-431 (SEQ ID NO:3287); miR-432 (SEQ ID NO:3288); miR-433 (SEQ ID NO:3289); miR-448 (SEQ ID NO:3290); miR-449a (SEQ ID NO:3291); miR-450a (SEQ ID NO:3292); miR-450b (SEQ ID NO:3293); miR-450c (SEQ ID NO:3294); miR-451 (SEQ ID NO:3295); miR-454 (SEQ ID NO:3296); miR-485 (SEQ ID NO:3297); miR-486 (SEQ ID NO:3298); miR-487a (SEQ ID NO:3299); miR-487b (SEQ ID NO:3300); miR-488 (SEQ ID NO:3301); miR-489 (SEQ ID NO:3302); miR-490 (SEQ ID NO:3303); miR-491 (SEQ ID NO:3304); miR-492-1 (SEQ ID NO:3305); miR-492-2 (SEQ ID NO:3306); miR-493a (SEQ ID NO:3307); miR-493b (SEQ ID NO:3308); miR-494 (SEQ ID NO:3309); miR-495 (SEQ ID NO:3310); miR-496 (SEQ ID NO:3311); miR-497 (SEQ ID NO:3312); miR-499 (SEQ ID NO:3313); miR-500-1 (SEQ ID NO:3314); miR-500-2 (SEQ ID NO:3315); miR-501 (SEQ ID NO:3316); miR-502 (SEQ ID NO:3317); miR-503 (SEQ ID NO:3318); miR-504 (SEQ ID NO:3319); miR-505 (SEQ ID NO:3320); miR-507 (SEQ ID NO:3321); miR-508 (SEQ ID NO:3322); miR-509 (SEQ ID NO:3323); miR-514 (SEQ ID NO:3324); miR-532 (SEQ ID NO:3325); miR-539 (SEQ ID NO:3326); miR-541 (SEQ ID NO:3327); miR-542 (SEQ ID NO:3328); miR-543 (SEQ ID NO:3329); miR-544-2 (SEQ ID NO:3330); miR-544b (SEQ ID NO:3331); miR-545 (SEQ ID NO:3332); miR-551a (SEQ ID NO:3333); miR-551b (SEQ ID NO:3334); miR-568 (SEQ ID NO:3335); miR-582 (SEQ ID NO:3336); miR-590 (SEQ ID NO:3337); miR-592 (SEQ ID NO:3338); miR-598 (SEQ ID NO:3339); miR-615 (SEQ ID NO:3340); miR-628a (SEQ ID NO:3341); miR-632 (SEQ ID NO:3342); miR-652 (SEQ ID NO:3343); miR-653 (SEQ ID NO:3344); miR-655 (SEQ ID NO:3345); miR-656 (SEQ ID NO:3346); miR-660 (SEQ ID NO:3347); miR-664 (SEQ ID NO:3348); miR-670 (SEQ ID NO:3349); miR-671 (SEQ ID NO:3350); miR-672 (SEQ ID NO:3351); miR-675 (SEQ ID NO:3352); miR-684 (SEQ ID NO:3353); miR-703 (SEQ ID NO:3354); miR-708 (SEQ ID NO:3355); miR-711 (SEQ ID NO:3356); miR-758 (SEQ ID NO:3357); miR-761 (SEQ ID NO:3358); miR-763 (SEQ ID NO:3359); miR-764 (SEQ ID NO:3360); miR-767 (SEQ ID NO:3361); miR-769a (SEQ ID NO:3362); miR-769b (SEQ ID NO:3363); miR-770 (SEQ ID NO:3364); miR-802 (SEQ ID NO:3365); miR-872 (SEQ ID NO:3366); miR-873 (SEQ ID NO:3367); miR-874 (SEQ ID NO:3368); miR-876 (SEQ ID NO:3369); miR-885 (SEQ ID NO:3370); miR-889 (SEQ ID NO:3371); miR-1179 (SEQ ID NO:3372); miR-1180 (SEQ ID NO:3373); miR-1185 (SEQ ID NO:3374); miR-1193 (SEQ ID NO:3375); miR-1197 (SEQ ID NO:3376); miR-1204 (SEQ ID NO:3377); miR-1244 (SEQ ID NO:3378); miR-1248 (SEQ ID NO:3379); miR-1255b (SEQ ID NO:3380); miR-1261 (SEQ ID NO:3381); miR-1264 (SEQ ID NO:3382); miR-1271 (SEQ ID NO:3383); miR-1282 (SEQ ID NO:3384); miR-1289 (SEQ ID NO:3385); miR-1291a (SEQ ID NO:3386); miR-1291b (SEQ ID NO:3387); miR-1296 (SEQ ID NO:3388); miR-1298 (SEQ ID NO:3389); miR-1301 (SEQ ID NO:3390); miR-1302-1 (SEQ ID NO:3391); miR-1302b-2 (SEQ ID NO:3392); miR-1302c-5 (SEQ ID NO:3393); miR-1302d-4 (SEQ ID NO:3394); miR-1302e-6 (SEQ ID NO:3395); miR-1302e-7 (SEQ ID NO:3396); miR-1461 (SEQ ID NO:3397); miR-1468 (SEQ ID NO:3398); miR-1597 (SEQ ID NO:3399); miR-1839 (SEQ ID NO:3400); miR-1842 (SEQ ID NO:3401); miR-1892 (SEQ ID NO:3402); miR-1898 (SEQ ID NO:3403); miR-1902 (SEQ ID NO:3404); miR-1905a (SEQ ID NO:3405); miR-1905b (SEQ ID NO:3406); miR-1905c (SEQ ID NO:3407); and miR-1912 (SEQ ID NO:3408).

The following mouse miRNAs could be used: let-7a-1 (SEQ ID NO:3409); let-7a-2 (SEQ ID NO:3410); let-7b (SEQ ID NO:3411); let-7c-1 (SEQ ID NO:3412); let-7c-2 (SEQ ID NO:3413); let-7d (SEQ ID NO:3414); let-7e (SEQ ID NO:3415); let-7f-1 (SEQ ID NO:3416); let-7f-2 (SEQ ID NO:3417); let-7g (SEQ ID NO:3418); let-7i (SEQ ID NO:3419); let-7j (SEQ ID NO:3420); let-7k (SEQ ID NO:3421); miR-1a-1 (SEQ ID NO:3422); miR-1a-2 (SEQ ID NO:3423); miR-1b (SEQ ID NO:3424); miR-7a-1 (SEQ ID NO:3425); miR-7a-2 (SEQ ID NO:3426); miR-7b (SEQ ID NO:3427); miR-9-1 (SEQ ID NO:3428); miR-9-2 (SEQ ID NO:3429); miR-9-3 (SEQ ID NO:3430); miR-10a (SEQ ID NO:3431); miR-10b (SEQ ID NO:3432); miR-15a (SEQ ID NO:3433); miR-15b (SEQ ID NO:3434); miR-16-1 (SEQ ID NO:3435); miR-16-2 (SEQ ID NO:3436); miR-17 (SEQ ID NO:3437); miR-18a (SEQ ID NO:3438); miR-18b (SEQ ID NO:3439); miR-19a (SEQ ID NO:3440); miR-19b-1 (SEQ ID NO:3441); miR-19b-2 (SEQ ID NO:3442); miR-20a (SEQ ID NO:3443); miR-20b (SEQ ID NO:3444); miR-21a (SEQ ID NO:3445); miR-21b (SEQ ID NO:3446); miR-21c (SEQ ID NO:3447); miR-22 (SEQ ID NO:3448); miR-23a (SEQ ID NO:3449); miR-23b (SEQ ID NO:3450); miR-24-1 (SEQ ID NO:3451); miR-24-2 (SEQ ID NO:3452); miR-25 (SEQ ID NO:3453); miR-26a-1 (SEQ ID NO:3454); miR-26a-2 (SEQ ID NO:3455); miR-26b (SEQ ID NO:3456); miR-27a (SEQ ID NO:3457); miR-27b (SEQ ID NO:3458); miR-28a (SEQ ID NO:3459); miR-28b (SEQ ID NO:3460); miR-28c (SEQ ID NO:3461); miR-29a (SEQ ID NO:3462); miR-29b-1 (SEQ ID NO:3463); miR-29b-2 (SEQ ID NO:3464); miR-29c (SEQ ID NO:3465); miR-30a (SEQ ID NO:3466); miR-30b (SEQ ID NO:3467); miR-30c-1 (SEQ ID NO:3468); miR-30c-2 (SEQ ID NO:3469); miR-30d (SEQ ID NO:3470); miR-30e (SEQ ID NO:3471); miR-30f (SEQ ID NO:3472); miR-31 (SEQ ID NO:3473); miR-32 (SEQ ID NO:3474); miR-33 (SEQ ID NO:3475); miR-34a (SEQ ID NO:3476); miR-34b (SEQ ID NO:3477); miR-34c (SEQ ID NO:3478); miR-92a-1 (SEQ ID NO:3479); miR-92a-2 (SEQ ID NO:3480); miR-92b (SEQ ID NO:3481); miR-93 (SEQ ID NO:3482); miR-96 (SEQ ID NO:3483); miR-98 (SEQ ID NO:3484); miR-99a (SEQ ID NO:3485); miR-99b (SEQ ID NO:3486); miR-100 (SEQ ID NO:3487); miR-101a (SEQ ID NO:3488); miR-101b (SEQ ID NO:3489); miR-101c (SEQ ID NO:3490); miR-103-1 (SEQ ID NO:3491); miR-103-2 (SEQ ID NO:3492); miR-105 (SEQ ID NO:3493); miR-106a (SEQ ID NO:3494); miR-106b (SEQ ID NO:3495); miR-107 (SEQ ID NO:3496); miR-122 (SEQ ID NO:3497); miR-124-1 (SEQ ID NO:3498); miR-124-2 (SEQ ID NO:3499); miR-124-3 (SEQ ID NO:3500); miR-125a (SEQ ID NO:3501); miR-125b-1 (SEQ ID NO:3502); miR-125b-2 (SEQ ID NO:3503); miR- 126a (SEQ ID NO:3504); miR-126b (SEQ ID NO:3505); miR-127 (SEQ ID NO:3506); miR-128-1 (SEQ ID NO:3507); miR-128-2 (SEQ ID NO:3508); miR-129-1 (SEQ ID NO:3509); miR-129-2 (SEQ ID NO:3510); miR-129b (SEQ ID NO:3511); miR-130a (SEQ ID NO:3512); miR-130b (SEQ ID NO:3513); miR-130c (SEQ ID NO:3514); miR-132 (SEQ ID NO:3515); miR-133a-1 (SEQ ID NO:3516); miR-133a-2 (SEQ ID NO:3517); miR-133b (SEQ ID NO:3518); miR-133c (SEQ ID NO:3519); miR-134 (SEQ ID NO:3520); miR-135a-1 (SEQ ID NO:3521); miR-135a-2 (SEQ ID NO:3522); miR-135b (SEQ ID NO:3523); miR-136 (SEQ ID NO:3524); miR-137 (SEQ ID NO:3525); miR-138-1 (SEQ ID NO:3526); miR-138-2 (SEQ ID NO:3527); miR-139 (SEQ ID NO:3528); miR-140 (SEQ ID NO:3529); miR-141 (SEQ ID NO:3530); miR-142 (SEQ ID NO:3531); miR-142b (SEQ ID NO:3532); miR-143 (SEQ ID NO:3533); miR-144 (SEQ ID NO:3534); miR-145a (SEQ ID NO:3535); miR-145b (SEQ ID NO:3536); miR-146a (SEQ ID NO:3537); miR-146b (SEQ ID NO:3538); miR-147 (SEQ ID NO:3539); miR-148a (SEQ ID NO:3540); miR-148b (SEQ ID NO:3541); miR-149 (SEQ ID NO:3542); miR-150 (SEQ ID NO:3543); miR-151 (SEQ ID NO:3544); miR-152 (SEQ ID NO:3545); miR-153 (SEQ ID NO:3546); miR-154 (SEQ ID NO:3547); miR-155 (SEQ ID NO:3548); miR-181a-1 (SEQ ID NO:3549); miR-181a-2 (SEQ ID NO:3550); miR-181b-1 (SEQ ID NO:3551); miR-181b-2 (SEQ ID NO:3552); miR-181c (SEQ ID NO:3553); miR-181d (SEQ ID NO:3554); miR-182 (SEQ ID NO:3555); miR-183 (SEQ ID NO:3556); miR-184 (SEQ ID NO:3557); miR-185 (SEQ ID NO:3558); miR-186 (SEQ ID NO:3559); miR-187 (SEQ ID NO:3560); miR-188 (SEQ ID NO:3561); miR-190a (SEQ ID NO:3562); miR-190b (SEQ ID NO:3563); miR-191 (SEQ ID NO:3564); miR-192 (SEQ ID NO:3565); miR-193a (SEQ ID NO:3566); miR-193b (SEQ ID NO:3567); miR-194-1 (SEQ ID NO:3568); miR-194-2 (SEQ ID NO:3569); miR-195a (SEQ ID NO:3570); miR-195b (SEQ ID NO:3571); miR-196a-1 (SEQ ID NO:3572); miR-196a-2 (SEQ ID NO:3573); miR-196b (SEQ ID NO:3574); miR-199a-1 (SEQ ID NO:3575); miR-199a-2 (SEQ ID NO:3576); miR-199b (SEQ ID NO:3577); miR-200a (SEQ ID NO:3578); miR-200b (SEQ ID NO:3579); miR-200c (SEQ ID NO:3580); miR-201 (SEQ ID NO:3581); miR-202 (SEQ ID NO:3582); miR-203 (SEQ ID NO:3583); miR-204 (SEQ ID NO:3584); miR-205 (SEQ ID NO:3585); miR-206 (SEQ ID NO:3586); miR-207 (SEQ ID NO:3587); miR-208a (SEQ ID NO:3588); miR-208b (SEQ ID NO:3589); miR-210 (SEQ ID NO:3590); miR-211 (SEQ ID NO:3591); miR-212 (SEQ ID NO:3592); miR-214 (SEQ ID NO:3593); miR-215 (SEQ ID NO:3594); miR-216a (SEQ ID NO:3595); miR-216b (SEQ ID NO:3596); miR-216c (SEQ ID NO:3597); miR-217 (SEQ ID NO:3598); miR-218-1 (SEQ ID NO:3599); miR-218-2 (SEQ ID NO:3600); miR-219a-1 (SEQ ID NO:3601); miR-219a-2 (SEQ ID NO:3602); miR-219b (SEQ ID NO:3603); miR-219c (SEQ ID NO:3604); miR-221 (SEQ ID NO:3605); miR-222 (SEQ ID NO:3606); miR-223 (SEQ ID NO:3607); miR-224 (SEQ ID NO:3608); miR-290a (SEQ ID NO:3609); miR-290b (SEQ ID NO:3610); miR-291a (SEQ ID NO:3611); miR-291b (SEQ ID NO:3612); miR-292 (SEQ ID NO:3613); miR-292b (SEQ ID NO:3614); miR-293 (SEQ ID NO:3615); miR-294 (SEQ ID NO:3616); miR-295 (SEQ ID NO:3617); miR-296 (SEQ ID NO:3618); miR-297a-1 (SEQ ID NO:3619); miR-297a-2 (SEQ ID NO:3620); miR-297a-3 (SEQ ID NO:3621); miR-297a-4 (SEQ ID NO:3622); miR-297b (SEQ ID NO:3623); miR-297c (SEQ ID NO:3624); miR-298 (SEQ ID NO:3625); miR-299a (SEQ ID NO:3626); miR-299b (SEQ ID NO:3627); miR-300 (SEQ ID NO:3628); miR-301a (SEQ ID NO:3629); miR-301b (SEQ ID NO:3630); miR-302a (SEQ ID NO:3631); miR-302b (SEQ ID NO:3632); miR-302c (SEQ ID NO:3633); miR-302d (SEQ ID NO:3634); miR-320 (SEQ ID NO:3635); miR-322 (SEQ ID NO:3636); miR-323 (SEQ ID NO:3637); miR-324 (SEQ ID NO:3638); miR-325 (SEQ ID NO:3639); miR-326 (SEQ ID NO:3640); miR-327 (SEQ ID NO:3641); miR-328 (SEQ ID NO:3642); miR-329 (SEQ ID NO:3643); miR-330 (SEQ ID NO:3644); miR-331 (SEQ ID NO:3645); miR-335 (SEQ ID NO:3646); miR-337 (SEQ ID NO:3647); miR-338 (SEQ ID NO:3648); miR-339 (SEQ ID NO:3649); miR-340 (SEQ ID NO:3650); miR-341 (SEQ ID NO:3651); miR-342 (SEQ ID NO:3652); miR-343 (SEQ ID NO:3653); miR-344-1 (SEQ ID NO:3654); miR-344-2 (SEQ ID NO:3655); miR-344b (SEQ ID NO:3656); miR-344c (SEQ ID NO:3657); miR-344d-1 (SEQ ID NO:3658); miR-344d-2 (SEQ ID NO:3659); miR-344d-3 (SEQ ID NO:3660); miR-344e (SEQ ID NO:3661); miR-344f (SEQ ID NO:3662); miR-344g (SEQ ID NO:3663); miR-344h-1 (SEQ ID NO:3664); miR-344h-2 (SEQ ID NO:3665); miR-344i (SEQ ID NO:3666); miR-345 (SEQ ID NO:3667); miR-346 (SEQ ID NO:3668); miR-350 (SEQ ID NO:3669); miR-351 (SEQ ID NO:3670); miR-361 (SEQ ID NO:3671); miR-362 (SEQ ID NO:3672); miR-363 (SEQ ID NO:3673); miR-365-1 (SEQ ID NO:3674); miR-365-2 (SEQ ID NO:3675); miR-367 (SEQ ID NO:3676); miR-369 (SEQ ID NO:3677); miR-370 (SEQ ID NO:3678); miR-374b (SEQ ID NO:3679); miR-374c (SEQ ID NO:3680); miR-375 (SEQ ID NO:3681); miR-376a (SEQ ID NO:3682); miR-376b (SEQ ID NO:3683); miR-376c (SEQ ID NO:3684); miR-377 (SEQ ID NO:3685); miR-378a (SEQ ID NO:3686); miR-378b (SEQ ID NO:3687); miR-378c (SEQ ID NO:3688); miR-378d (SEQ ID NO:3689); miR-379 (SEQ ID NO:3690); miR-380 (SEQ ID NO:3691); miR-381 (SEQ ID NO:3692); miR-382 (SEQ ID NO:3693); miR-383 (SEQ ID NO:3694); miR-384 (SEQ ID NO:3695); miR-409 (SEQ ID NO:3696); miR-410 (SEQ ID NO:3697); miR-411 (SEQ ID NO:3698); miR-412 (SEQ ID NO:3699); miR-421 (SEQ ID NO:3700); miR-423 (SEQ ID NO:3701); miR-425 (SEQ ID NO:3702); miR-429 (SEQ ID NO:3703); miR-431 (SEQ ID NO:3704); miR-432 (SEQ ID NO:3705); miR-433 (SEQ ID NO:3706); miR-434 (SEQ ID NO:3707); miR-448 (SEQ ID NO:3708); miR-449a (SEQ ID NO:3709); miR-449b (SEQ ID NO:3710); miR-449c (SEQ ID NO:3711); miR-450a-1 (SEQ ID NO:3712); miR-450a-2 (SEQ ID NO:3713); miR-450b (SEQ ID NO:3714); miR-451a (SEQ ID NO:3715); miR-451b (SEQ ID NO:3716); miR-452 (SEQ ID NO:3717); miR-453 (SEQ ID NO:3718); miR-455 (SEQ ID NO:3719); miR-463 (SEQ ID NO:3720); miR-465a (SEQ ID NO:3721); miR-465b-1 (SEQ ID NO:3722); miR-465b-2 (SEQ ID NO:3723); miR-465c-1 (SEQ ID NO:3724); miR-465c-2 (SEQ ID NO:3725); miR-465d (SEQ ID NO:3726); miR-466a (SEQ ID NO:3727); miR-466b-1 (SEQ ID NO:3728); miR-466b-2 (SEQ ID NO:3729); miR-466b-3 (SEQ ID NO:3730); miR-466b-4 (SEQ ID NO:3731); miR-466b-5 (SEQ ID NO:3732); miR-466b-6 (SEQ ID NO:3733); miR-466b-7 (SEQ ID NO:3734); miR-466b-8 (SEQ ID NO:3735); miR-466c-1 (SEQ ID NO:3736); miR-466c-2 (SEQ ID NO:3737); miR-466d (SEQ ID NO:3738); miR-466e (SEQ ID NO:3739); miR-466f-1 (SEQ ID NO:3740); miR-466f-2 (SEQ ID NO:3741); miR-466f-3 (SEQ ID NO:3742); miR-466f-4 (SEQ ID NO:3743); miR-466g (SEQ ID NO:3744); miR-466h (SEQ ID NO:3745); miR-466i (SEQ ID NO:3746); miR-466j (SEQ ID NO:3747); miR-466k (SEQ ID NO:3748); miR-466l (SEQ ID NO:3749); miR-466m (SEQ ID NO:3750); miR-466n (SEQ ID NO:3751); miR-466o (SEQ ID NO:3752); miR-466p (SEQ ID NO:3753); miR-466q (SEQ ID NO:3754); miR-467a-1 (SEQ ID NO:3755);

miR-467a-10 (SEQ ID NO:3756); miR-467a-2 (SEQ ID NO:3757); miR-467a-3 (SEQ ID NO:3758); miR-467a-4 (SEQ ID NO:3759); miR-467a-5 (SEQ ID NO:3760); miR-467a-6 (SEQ ID NO:3761); miR-467a-7 (SEQ ID NO:3762); miR-467a-8 (SEQ ID NO:3763); miR-467a-9 (SEQ ID NO:3764); miR-467b (SEQ ID NO:3765); miR-467c (SEQ ID NO:3766); miR-467d (SEQ ID NO:3767); miR-467e (SEQ ID NO:3768); miR-467f (SEQ ID NO:3769); miR-467g (SEQ ID NO:3770); miR-467h (SEQ ID NO:3771); miR-468 (SEQ ID NO:3772); miR-470 (SEQ ID NO:3773); miR-471 (SEQ ID NO:3774); miR-483 (SEQ ID NO:3775); miR-484 (SEQ ID NO:3776); miR-485 (SEQ ID NO:3777); miR-486 (SEQ ID NO:3778); miR-487b (SEQ ID NO:3779); miR-488 (SEQ ID NO:3780); miR-489 (SEQ ID NO:3781); miR-490 (SEQ ID NO:3782); miR-491 (SEQ ID NO:3783); miR-493 (SEQ ID NO:3784); miR-494 (SEQ ID NO:3785); miR-495 (SEQ ID NO:3786); miR-496a (SEQ ID NO:3787); miR-496b (SEQ ID NO:3788); miR-497 (SEQ ID NO:3789); miR-497b (SEQ ID NO:3790); miR-499 (SEQ ID NO:3791); miR-500 (SEQ ID NO:3792); miR-501 (SEQ ID NO:3793); miR-503 (SEQ ID NO:3794); miR-504 (SEQ ID NO:3795); miR-505 (SEQ ID NO:3796); miR-509 (SEQ ID NO:3797); miR-511 (SEQ ID NO:3798); miR-532 (SEQ ID NO:3799); miR-539 (SEQ ID NO:3800); miR-540 (SEQ ID NO:3801); miR-541 (SEQ ID NO:3802); miR-542 (SEQ ID NO:3803); miR-543 (SEQ ID NO:3804); miR-544 (SEQ ID NO:3805); miR-546 (SEQ ID NO:3806); miR-547 (SEQ ID NO:3807); miR-551b (SEQ ID NO:3808); miR-568 (SEQ ID NO:3809); miR-574 (SEQ ID NO:3810); miR-582 (SEQ ID NO:3811); miR-590 (SEQ ID NO:3812); miR-592 (SEQ ID NO:3813); miR-598 (SEQ ID NO:3814); miR-599 (SEQ ID NO:3815); miR-615 (SEQ ID NO:3816); miR-652 (SEQ ID NO:3817); miR-653 (SEQ ID NO:3818); miR-654 (SEQ ID NO:3819); miR-664 (SEQ ID NO:3820); miR-665 (SEQ ID NO:3821); miR-666 (SEQ ID NO:3822); miR-667 (SEQ ID NO:3823); miR-668 (SEQ ID NO:3824); miR-669a-1 (SEQ ID NO:3825); miR-669a-10 (SEQ ID NO:3826); miR-669a-11 (SEQ ID NO:3827); miR-669a-12 (SEQ ID NO:3828); miR-669a-2 (SEQ ID NO:3829); miR-669a-3 (SEQ ID NO:3830); miR-669a-4 (SEQ ID NO:3831); miR-669a-5 (SEQ ID NO:3832); miR-669a-6 (SEQ ID NO:3833); miR-669a-7 (SEQ ID NO:3834); miR-669a-8 (SEQ ID NO:3835); miR-669a-9 (SEQ ID NO:3836); miR-669b (SEQ ID NO:3837); miR-669c (SEQ ID NO:3838); miR-669d (SEQ ID NO:3839); miR-669d-2 (SEQ ID NO:3840); miR-669e (SEQ ID NO:3841); miR-669f (SEQ ID NO:3842); miR-669g (SEQ ID NO:3843); miR-669h (SEQ ID NO:3844); miR-669i (SEQ ID NO:3845); miR-669j (SEQ ID NO:3846); miR-669k (SEQ ID NO:3847); miR-669l (SEQ ID NO:3848); miR-669m-1 (SEQ ID NO:3849); miR-669m-2 (SEQ ID NO:3850); miR-669n (SEQ ID NO:3851); miR-669o (SEQ ID NO:3852); miR-669p-1 (SEQ ID NO:3853); miR-669p-2 (SEQ ID NO:3854); miR-670 (SEQ ID NO:3855); miR-671 (SEQ ID NO:3856); miR-672 (SEQ ID NO:3857); miR-673 (SEQ ID NO:3858); miR-674 (SEQ ID NO:3859); miR-675 (SEQ ID NO:3860); miR-676 (SEQ ID NO:3861); miR-677 (SEQ ID NO:3862); miR-678 (SEQ ID NO:3863); miR-679 (SEQ ID NO:3864); miR-680-1 (SEQ ID NO:3865); miR-680-2 (SEQ ID NO:3866); miR-680-3 (SEQ ID NO:3867); miR-681 (SEQ ID NO:3868); miR-682 (SEQ ID NO:3869); miR-683-1 (SEQ ID NO:3870); miR-683-2 (SEQ ID NO:3871); miR-684-1 (SEQ ID NO:3872); miR-684-2 (SEQ ID NO:3873); miR-686 (SEQ ID NO:3874); miR-687 (SEQ ID NO:3875); miR-688 (SEQ ID NO:3876); miR-690 (SEQ ID NO:3877); miR-691 (SEQ ID NO:3878); miR-692-1 (SEQ ID NO:3879); miR-692-2 (SEQ ID NO:3880); miR-692-3 (SEQ ID NO:3881); miR-693 (SEQ ID NO:3882); miR-694 (SEQ ID NO:3883); miR-695 (SEQ ID NO:3884); miR-696 (SEQ ID NO:3885); miR-697 (SEQ ID NO:3886); miR-698 (SEQ ID NO:3887); miR-700 (SEQ ID NO:3888); miR-701 (SEQ ID NO:3889); miR-702 (SEQ ID NO:3890); miR-703 (SEQ ID NO:3891); miR-704 (SEQ ID NO:3892); miR-705 (SEQ ID NO:3893); miR-706 (SEQ ID NO:3894); miR-707 (SEQ ID NO:3895); miR-708 (SEQ ID NO:3896); miR-709 (SEQ ID NO:3897); miR-710 (SEQ ID NO:3898); miR-711 (SEQ ID NO:3899); miR-712 (SEQ ID NO:3900); miR-713 (SEQ ID NO:3901); miR-714 (SEQ ID NO:3902); miR-717 (SEQ ID NO:3903); miR-718 (SEQ ID NO:3904); miR-719 (SEQ ID NO:3905); miR-721 (SEQ ID NO:3906); miR-741 (SEQ ID NO:3907); miR-742 (SEQ ID NO:3908); miR-743a (SEQ ID NO:3909); miR-743b (SEQ ID NO:3910); miR-744 (SEQ ID NO:3911); miR-758 (SEQ ID NO:3912); miR-759 (SEQ ID NO:3913); miR-760 (SEQ ID NO:3914); miR-761 (SEQ ID NO:3915); miR-762 (SEQ ID NO:3916); miR-763 (SEQ ID NO:3917); miR-764 (SEQ ID NO:3918); miR-767 (SEQ ID NO:3919); miR-770 (SEQ ID NO:3920); miR-802 (SEQ ID NO:3921); miR-804 (SEQ ID NO:3922); miR-871 (SEQ ID NO:3923); miR-872 (SEQ ID NO:3924); miR-873a (SEQ ID NO:3925); miR-873b (SEQ ID NO:3926); miR-874 (SEQ ID NO:3927); miR-875 (SEQ ID NO:3928); miR-876 (SEQ ID NO:3929); miR-877 (SEQ ID NO:3930); miR-878 (SEQ ID NO:3931); miR-879 (SEQ ID NO:3932); miR-880 (SEQ ID NO:3933); miR-881 (SEQ ID NO:3934); miR-882 (SEQ ID NO:3935); miR-883a (SEQ ID NO:3936); miR-883b (SEQ ID NO:3937); miR-1187 (SEQ ID NO:3938); miR-1188 (SEQ ID NO:3939); miR-1190 (SEQ ID NO:3940); miR-1191 (SEQ ID NO:3941); miR-1191b (SEQ ID NO:3942); miR-1192 (SEQ ID NO:3943); miR-1193 (SEQ ID NO:3944); miR-1194 (SEQ ID NO:3945); miR-1195 (SEQ ID NO:3946); miR-1197 (SEQ ID NO:3947); miR-1198 (SEQ ID NO:3948); miR-1199 (SEQ ID NO:3949); miR-1224 (SEQ ID NO:3950); miR-1231 (SEQ ID NO:3951); miR-1247 (SEQ ID NO:3952); miR-1249 (SEQ ID NO:3953); miR-1251 (SEQ ID NO:3954); miR-1258 (SEQ ID NO:3955); miR-1264 (SEQ ID NO:3956); miR-1291 (SEQ ID NO:3957); miR-1298 (SEQ ID NO:3958); miR-1306 (SEQ ID NO:3959); miR-1668 (SEQ ID NO:3960); miR-1839 (SEQ ID NO:3961); miR-1843a (SEQ ID NO:3962); miR-1843b (SEQ ID NO:3963); miR-1892 (SEQ ID NO:3964); miR-1893 (SEQ ID NO:3965); miR-1894 (SEQ ID NO:3966); miR-1895 (SEQ ID NO:3967); miR-1896 (SEQ ID NO:3968); miR-1897 (SEQ ID NO:3969); miR-1898 (SEQ ID NO:3970); miR-1899 (SEQ ID NO:3971); miR-1900 (SEQ ID NO:3972); miR-1901 (SEQ ID NO:3973); miR-1902 (SEQ ID NO:3974); miR-1903 (SEQ ID NO:3975); miR-1904 (SEQ ID NO:3976); miR-1905 (SEQ ID NO:3977); miR-1906-1 (SEQ ID NO:3978); miR-1906-2 (SEQ ID NO:3979); miR-1907 (SEQ ID NO:3980); miR-1912 (SEQ ID NO:3981); miR-1927 (SEQ ID NO:3982); miR-1928 (SEQ ID NO:3983); miR-1929 (SEQ ID NO:3984); miR-1930 (SEQ ID NO:3985); miR-1931 (SEQ ID NO:3986); miR-1932 (SEQ ID NO:3987); miR-1933 (SEQ ID NO:3988); miR-1934 (SEQ ID NO:3989); miR-1936 (SEQ ID NO:3990); miR-1938 (SEQ ID NO:3991); miR-1940 (SEQ ID NO:3992); miR-1941 (SEQ ID NO:3993); miR-1942 (SEQ ID NO:3994); miR-1943 (SEQ ID NO:3995); miR-1945 (SEQ ID NO:3996); miR-1946a (SEQ ID NO:3997); miR-1946b (SEQ ID NO:3998); miR-1947 (SEQ ID NO:3999); miR-1948 (SEQ ID NO:4000); miR-1949 (SEQ ID NO:4001); miR-1950 (SEQ ID NO:4002); miR-1951 (SEQ ID NO:4003); miR-1952 (SEQ ID NO:4004); miR-1953 (SEQ ID NO:4005); miR-1954 (SEQ ID NO:4006); miR-1955 (SEQ ID NO:4007);

miR-1956 (SEQ ID NO:4008); miR-1957a (SEQ ID NO:4009); miR-1957b (SEQ ID NO:4010); miR-1958 (SEQ ID NO:4011); miR-1960 (SEQ ID NO:4012); miR-1961 (SEQ ID NO:4013); miR-1962 (SEQ ID NO:4014); miR-1963 (SEQ ID NO:4015); miR-1964 (SEQ ID NO:4016); miR-1966 (SEQ ID NO:4017); miR-1967 (SEQ ID NO:4018); miR-1968 (SEQ ID NO:4019); miR-1969 (SEQ ID NO:4020); miR-1970 (SEQ ID NO:4021); miR-1971 (SEQ ID NO:4022); miR-1981 (SEQ ID NO:4023); miR-1982 (SEQ ID NO:4024); miR-1983 (SEQ ID NO:4025); miR-2136 (SEQ ID NO:4026); miR-2137 (SEQ ID NO:4027); miR-2139 (SEQ ID NO:4028); miR-2183 (SEQ ID NO:4029); miR-2861 (SEQ ID NO:4030); miR-3057 (SEQ ID NO:4031); miR-3058 (SEQ ID NO:4032); miR-3059 (SEQ ID NO:4033); miR-3060 (SEQ ID NO:4034); miR-3061 (SEQ ID NO:4035); miR-3062 (SEQ ID NO:4036); miR-3063 (SEQ ID NO:4037); miR-3064 (SEQ ID NO:4038); miR-3065 (SEQ ID NO:4039); miR-3066 (SEQ ID NO:4040); miR-3067 (SEQ ID NO:4041); miR-3068 (SEQ ID NO:4042); miR-3069 (SEQ ID NO:4043); miR-3070a (SEQ ID NO:4044); miR-3070b (SEQ ID NO:4045); miR-3071 (SEQ ID NO:4046); miR-3072 (SEQ ID NO:4047); miR-3073a (SEQ ID NO:4048); miR-3073b (SEQ ID NO:4049); miR-3074-1 (SEQ ID NO:4050); miR-3074-2 (SEQ ID NO:4051); miR-3075 (SEQ ID NO:4052); miR-3076 (SEQ ID NO:4053); miR-3077 (SEQ ID NO:4054); miR-3078 (SEQ ID NO:4055); miR-3079 (SEQ ID NO:4056); miR-3080 (SEQ ID NO:4057); miR-3081 (SEQ ID NO:4058); miR-3082 (SEQ ID NO:4059); miR-3083 (SEQ ID NO:4060); miR-3084-1 (SEQ ID NO:4061); miR-3084-2 (SEQ ID NO:4062); miR-3085 (SEQ ID NO:4063); miR-3086 (SEQ ID NO:4064); miR-3087 (SEQ ID NO:4065); miR-3088 (SEQ ID NO:4066); miR-3089 (SEQ ID NO:4067); miR-3090 (SEQ ID NO:4068); miR-3091 (SEQ ID NO:4069); miR-3092 (SEQ ID NO:4070); miR-3093 (SEQ ID NO:4071); miR-3094 (SEQ ID NO:4072); miR-3095 (SEQ ID NO:4073); miR-3097 (SEQ ID NO:4074); miR-3098 (SEQ ID NO:4075); miR-3099 (SEQ ID NO:4076); miR-3100 (SEQ ID NO:4077); miR-3101 (SEQ ID NO:4078); miR-3102 (SEQ ID NO:4079); miR-3103 (SEQ ID NO:4080); miR-3104 (SEQ ID NO:4081); miR-3105 (SEQ ID NO:4082); miR-3106 (SEQ ID NO:4083); miR-3107 (SEQ ID NO:4084); miR-3108 (SEQ ID NO:4085); miR-3109 (SEQ ID NO:4086); miR-3110 (SEQ ID NO:4087); miR-3112 (SEQ ID NO:4088); miR-3113 (SEQ ID NO:4089); miR-3470a (SEQ ID NO:4090); miR-3470b (SEQ ID NO:4091); miR-3471-1 (SEQ ID NO:4092); miR-3471-2 (SEQ ID NO:4093); miR-3472 (SEQ ID NO:4094); miR-3473a (SEQ ID NO:4095); miR-3473b (SEQ ID NO:4096); miR-3473c (SEQ ID NO:4097); miR-3473d (SEQ ID NO:4098); miR-3473e (SEQ ID NO:4099); miR-3473f (SEQ ID NO:4100); miR-3473g (SEQ ID NO:4101); miR-3474 (SEQ ID NO:4102); miR-3475 (SEQ ID NO:4103); miR-3535 (SEQ ID NO:4104); miR-3544 (SEQ ID NO:4105); miR-3547 (SEQ ID NO:4106); miR-3569 (SEQ ID NO:4107); miR-3572 (SEQ ID NO:4108); miR-3620 (SEQ ID NO:4109); miR-3960 (SEQ ID NO:4110); miR-3961 (SEQ ID NO:4111); miR-3962 (SEQ ID NO:4112); miR-3963 (SEQ ID NO:4113); miR-3964 (SEQ ID NO:4114); miR-3965 (SEQ ID NO:4115); miR-3966 (SEQ ID NO:4116); miR-3967 (SEQ ID NO:4117); miR-3968 (SEQ ID NO:4118); miR-3969 (SEQ ID NO:4119); miR-3970 (SEQ ID NO:4120); miR-3971 (SEQ ID NO:4121); miR-5046 (SEQ ID NO:4122); miR-5098 (SEQ ID NO:4123); miR-5099 (SEQ ID NO:4124); miR-5100 (SEQ ID NO:4125); miR-5101 (SEQ ID NO:4126); miR-5103 (SEQ ID NO:4127); miR-5104 (SEQ ID NO:4128); miR-5106 (SEQ ID NO:4129); miR-5107 (SEQ ID NO:4130); miR-5108 (SEQ ID NO:4131); miR-5110 (SEQ ID NO:4132); miR-5112 (SEQ ID NO:4133); miR-5113 (SEQ ID NO:4134); miR-5114 (SEQ ID NO:4135); miR-5116 (SEQ ID NO:4136); miR-5118 (SEQ ID NO:4137); miR-5119 (SEQ ID NO:4138); miR-5120 (SEQ ID NO:4139); miR-5121 (SEQ ID NO:4140); miR-5122 (SEQ ID NO:4141); miR-5123 (SEQ ID NO:4142); miR-5124a (SEQ ID NO:4143); miR-5124b (SEQ ID NO:4144); miR-5125 (SEQ ID NO:4145); miR-5126 (SEQ ID NO:4146); miR-5127 (SEQ ID NO:4147); miR-5128 (SEQ ID NO:4148); miR-5129 (SEQ ID NO:4149); miR-5130 (SEQ ID NO:4150); miR-5131 (SEQ ID NO:4151); miR-5132 (SEQ ID NO:4152); miR-5133 (SEQ ID NO:4153); miR-5134 (SEQ ID NO:4154); miR-5135 (SEQ ID NO:4155); miR-5136 (SEQ ID NO:4156); miR-5615-1 (SEQ ID NO:4157); miR-5615-2 (SEQ ID NO:4158); miR-5616 (SEQ ID NO:4159); miR-5617 (SEQ ID NO:4160); miR-5618 (SEQ ID NO:4161); miR-5619 (SEQ ID NO:4162); miR-5620 (SEQ ID NO:4163); miR-5621 (SEQ ID NO:4164); miR-5622 (SEQ ID NO:4165); miR-5623 (SEQ ID NO:4166); miR-5624 (SEQ ID NO:4167); miR-5625 (SEQ ID NO:4168); miR-5626 (SEQ ID NO:4169); miR-5627 (SEQ ID NO:4170); miR-5709 (SEQ ID NO:4171); miR-5710 (SEQ ID NO:4172); miR-6236 (SEQ ID NO:4173); miR-6237 (SEQ ID NO:4174); miR-6238 (SEQ ID NO:4175); miR-6239 (SEQ ID NO:4176); miR-6240 (SEQ ID NO:4177); miR-6241 (SEQ ID NO:4178); miR-6244 (SEQ ID NO:4179); miR-6335 (SEQ ID NO:4180); miR-6336 (SEQ ID NO:4181); miR-6337 (SEQ ID NO:4182); miR-6338 (SEQ ID NO:4183); miR-6339 (SEQ ID NO:4184); miR-6340 (SEQ ID NO:4185); miR-6341 (SEQ ID NO:4186); miR-6342 (SEQ ID NO:4187); miR-6343 (SEQ ID NO:4188); miR-6344 (SEQ ID NO:4189); miR-6345 (SEQ ID NO:4190); miR-6346 (SEQ ID NO:4191); miR-6347 (SEQ ID NO:4192); miR-6348 (SEQ ID NO:4193); miR-6349 (SEQ ID NO:4194); miR-6350 (SEQ ID NO:4195); miR-6351 (SEQ ID NO:4196); miR-6352 (SEQ ID NO:4197); miR-6353 (SEQ ID NO:4198); miR-6354 (SEQ ID NO:4199); miR-6355 (SEQ ID NO:4200); miR-6356 (SEQ ID NO:4201); miR-6357 (SEQ ID NO:4202); miR-6358 (SEQ ID NO:4203); miR-6359 (SEQ ID NO:4204); miR-6360 (SEQ ID NO:4205); miR-6361 (SEQ ID NO:4206); miR-6362 (SEQ ID NO:4207); miR-6363 (SEQ ID NO:4208); miR-6364 (SEQ ID NO:4209); miR-6365 (SEQ ID NO:4210); miR-6366 (SEQ ID NO:4211); miR-6367 (SEQ ID NO:4212); miR-6368 (SEQ ID NO:4213); miR-6369 (SEQ ID NO:4214); miR-6370 (SEQ ID NO:4215); miR-6371 (SEQ ID NO:4216); miR-6372 (SEQ ID NO:4217); miR-6373 (SEQ ID NO:4218); miR-6374 (SEQ ID NO:4219); miR-6375 (SEQ ID NO:4220); miR-6376 (SEQ ID NO:4221); miR-6377 (SEQ ID NO:4222); miR-6378 (SEQ ID NO:4223); miR-6379 (SEQ ID NO:4224); miR-6380 (SEQ ID NO:4225); miR-6381 (SEQ ID NO:4226); miR-6382 (SEQ ID NO:4227); miR-6383 (SEQ ID NO:4228); miR-6384 (SEQ ID NO:4229); miR-6385 (SEQ ID NO:4230); miR-6386 (SEQ ID NO:4231); miR-6387 (SEQ ID NO:4232); miR-6388 (SEQ ID NO:4233); miR-6389 (SEQ ID NO:4234); miR-6390 (SEQ ID NO:4235); miR-6391 (SEQ ID NO:4236); miR-6392 (SEQ ID NO:4237); miR-6393 (SEQ ID NO:4238); miR-6394 (SEQ ID NO:4239); miR-6395 (SEQ ID NO:4240); miR-6396 (SEQ ID NO:4241); miR-6397 (SEQ ID NO:4242); miR-6398 (SEQ ID NO:4243); miR-6399 (SEQ ID NO:4244); miR-6400 (SEQ ID NO:4245); miR-6401 (SEQ ID NO:4246); miR-6402 (SEQ ID NO:4247); miR-6403 (SEQ ID

NO:4248); miR-6404 (SEQ ID NO:4249); miR-6405 (SEQ ID NO:4250); miR-6406 (SEQ ID NO:4251); miR-6407 (SEQ ID NO:4252); miR-6408 (SEQ ID NO:4253); miR-6409 (SEQ ID NO:4254); miR-6410 (SEQ ID NO:4255); miR-6411 (SEQ ID NO:4256); miR-6412 (SEQ ID NO:4257); miR-6413 (SEQ ID NO:4258); miR-6414 (SEQ ID NO:4259); miR-6415 (SEQ ID NO:4260); miR-6416 (SEQ ID NO:4261); miR-6417 (SEQ ID NO:4262); miR-6418 (SEQ ID NO:4263); miR-6419 (SEQ ID NO:4264); miR-6420 (SEQ ID NO:4265); miR-6481 (SEQ ID NO:4266); miR-6516 (SEQ ID NO:4267); miR-6537 (SEQ ID NO:4268); miR-6538 (SEQ ID NO:4269); miR-6539 (SEQ ID NO:4270); miR-6540 (SEQ ID NO:4271); miR-6541 (SEQ ID NO:4272); miR-6546 (SEQ ID NO:4273); miR-6715 (SEQ ID NO:4274); miR-6769b (SEQ ID NO:4275); miR-6896 (SEQ ID NO:4276); miR-6897 (SEQ ID NO:4277); miR-6898 (SEQ ID NO:4278); miR-6899 (SEQ ID NO:4279); miR-6900 (SEQ ID NO:4280); miR-6901 (SEQ ID NO:4281); miR-6902 (SEQ ID NO:4282); miR-6903 (SEQ ID NO:4283); miR-6904 (SEQ ID NO:4284); miR-6905 (SEQ ID NO:4285); miR-6906 (SEQ ID NO:4286); miR-6907 (SEQ ID NO:4287); miR-6908 (SEQ ID NO:4288); miR-6909 (SEQ ID NO:4289); miR-6910 (SEQ ID NO:4290); miR-6911 (SEQ ID NO:4291); miR-6912 (SEQ ID NO:4292); miR-6913 (SEQ ID NO:4293); miR-6914 (SEQ ID NO:4294); miR-6915 (SEQ ID NO:4295); miR-6916 (SEQ ID NO:4296); miR-6917 (SEQ ID NO:4297); miR-6918 (SEQ ID NO:4298); miR-6919 (SEQ ID NO:4299); miR-6920 (SEQ ID NO:4300); miR-6921 (SEQ ID NO:4301); miR-6922 (SEQ ID NO:4302); miR-6923 (SEQ ID NO:4303); miR-6924 (SEQ ID NO:4304); miR-6925 (SEQ ID NO:4305); miR-6926 (SEQ ID NO:4306); miR-6927 (SEQ ID NO:4307); miR-6928 (SEQ ID NO:4308); miR-6929 (SEQ ID NO:4309); miR-6930 (SEQ ID NO:4310); miR-6931 (SEQ ID NO:4311); miR-6932 (SEQ ID NO:4312); miR-6933 (SEQ ID NO:4313); miR-6934 (SEQ ID NO:4314); miR-6935 (SEQ ID NO:4315); miR-6936 (SEQ ID NO:4316); miR-6937 (SEQ ID NO:4317); miR-6938 (SEQ ID NO:4318); miR-6939 (SEQ ID NO:4319); miR-6940 (SEQ ID NO:4320); miR-6941 (SEQ ID NO:4321); miR-6942 (SEQ ID NO:4322); miR-6943 (SEQ ID NO:4323); miR-6944 (SEQ ID NO:4324); miR-6945 (SEQ ID NO:4325); miR-6946 (SEQ ID NO:4326); miR-6947 (SEQ ID NO:4327); miR-6948 (SEQ ID NO:4328); miR-6949 (SEQ ID NO:4329); miR-6950 (SEQ ID NO:4330); miR-6951 (SEQ ID NO:4331); miR-6952 (SEQ ID NO:4332); miR-6953 (SEQ ID NO:4333); miR-6954 (SEQ ID NO:4334); miR-6955 (SEQ ID NO:4335); miR-6956 (SEQ ID NO:4336); miR-6957 (SEQ ID NO:4337); miR-6958 (SEQ ID NO:4338); miR-6959 (SEQ ID NO:4339); miR-6960 (SEQ ID NO:4340); miR-6961 (SEQ ID NO:4341); miR-6962 (SEQ ID NO:4342); miR-6963 (SEQ ID NO:4343); miR-6964 (SEQ ID NO:4344); miR-6965 (SEQ ID NO:4345); miR-6966 (SEQ ID NO:4346); miR-6967 (SEQ ID NO:4347); miR-6968 (SEQ ID NO:4348); miR-6969 (SEQ ID NO:4349); miR-6970 (SEQ ID NO:4350); miR-6971 (SEQ ID NO:4351); miR-6972 (SEQ ID NO:4352); miR-6973a (SEQ ID NO:4353); miR-6973b (SEQ ID NO:4354); miR-6974 (SEQ ID NO:4355); miR-6975 (SEQ ID NO:4356); miR-6976 (SEQ ID NO:4357); miR-6977 (SEQ ID NO:4358); miR-6978 (SEQ ID NO:4359); miR-6979 (SEQ ID NO:4360); miR-6980 (SEQ ID NO:4361); miR-6981 (SEQ ID NO:4362); miR-6982 (SEQ ID NO:4363); miR-6983 (SEQ ID NO:4364); miR-6984 (SEQ ID NO:4365); miR-6985 (SEQ ID NO:4366); miR-6986 (SEQ ID NO:4367); miR-6987 (SEQ ID NO:4368); miR-6988 (SEQ ID NO:4369); miR-6989 (SEQ ID NO:4370); miR-6990 (SEQ ID NO:4371); miR-6991 (SEQ ID NO:4372); miR-6992 (SEQ ID NO:4373); miR-6993 (SEQ ID NO:4374); miR-6994 (SEQ ID NO:4375); miR-6995 (SEQ ID NO:4376); miR-6996 (SEQ ID NO:4377); miR-6997 (SEQ ID NO:4378); miR-6998 (SEQ ID NO:4379); miR-6999 (SEQ ID NO:4380); miR-7000 (SEQ ID NO:4381); miR-7001 (SEQ ID NO:4382); miR-7002 (SEQ ID NO:4383); miR-7003 (SEQ ID NO:4384); miR-7004 (SEQ ID NO:4385); miR-7005 (SEQ ID NO:4386); miR-7006 (SEQ ID NO:4387); miR-7007 (SEQ ID NO:4388); miR-7008 (SEQ ID NO:4389); miR-7009 (SEQ ID NO:4390); miR-7010 (SEQ ID NO:4391); miR-7011 (SEQ ID NO:4392); miR-7012 (SEQ ID NO:4393); miR-7013 (SEQ ID NO:4394); miR-7014 (SEQ ID NO:4395); miR-7015 (SEQ ID NO:4396); miR-7016 (SEQ ID NO:4397); miR-7017 (SEQ ID NO:4398); miR-7018 (SEQ ID NO:4399); miR-7019 (SEQ ID NO:4400); miR-7020 (SEQ ID NO:4401); miR-7021 (SEQ ID NO:4402); miR-7022 (SEQ ID NO:4403); miR-7023 (SEQ ID NO:4404); miR-7024 (SEQ ID NO:4405); miR-7025 (SEQ ID NO:4406); miR-7026 (SEQ ID NO:4407); miR-7027 (SEQ ID NO:4408); miR-7028 (SEQ ID NO:4409); miR-7029 (SEQ ID NO:4410); miR-7030 (SEQ ID NO:4411); miR-7031 (SEQ ID NO:4412); miR-7032 (SEQ ID NO:4413); miR-7033 (SEQ ID NO:4414); miR-7034 (SEQ ID NO:4415); miR-7035 (SEQ ID NO:4416); miR-7036 (SEQ ID NO:4417); miR-7036b (SEQ ID NO:4418); miR-7037 (SEQ ID NO:4419); miR-7038 (SEQ ID NO:4420); miR-7039 (SEQ ID NO:4421); miR-7040 (SEQ ID NO:4422); miR-7041 (SEQ ID NO:4423); miR-7042 (SEQ ID NO:4424); miR-7043 (SEQ ID NO:4425); miR-7044 (SEQ ID NO:4426); miR-7045 (SEQ ID NO:4427); miR-7046 (SEQ ID NO:4428); miR-7047 (SEQ ID NO:4429); miR-7048 (SEQ ID NO:4430); miR-7049 (SEQ ID NO:4431); miR-7050 (SEQ ID NO:4432); miR-7051 (SEQ ID NO:4433); miR-7052 (SEQ ID NO:4434); miR-7053 (SEQ ID NO:4435); miR-7054 (SEQ ID NO:4436); miR-7055 (SEQ ID NO:4437); miR-7056 (SEQ ID NO:4438); miR-7057 (SEQ ID NO:4439); miR-7058 (SEQ ID NO:4440); miR-7059 (SEQ ID NO:4441); miR-7060 (SEQ ID NO:4442); miR-7061 (SEQ ID NO:4443); miR-7062 (SEQ ID NO:4444); miR-7063 (SEQ ID NO:4445); miR-7064 (SEQ ID NO:4446); miR-7065 (SEQ ID NO:4447); miR-7066 (SEQ ID NO:4448); miR-7067 (SEQ ID NO:4449); miR-7068 (SEQ ID NO:4450); miR-7069 (SEQ ID NO:4451); miR-7070 (SEQ ID NO:4452); miR-7071 (SEQ ID NO:4453); miR-7072 (SEQ ID NO:4454); miR-7073 (SEQ ID NO:4455); miR-7074 (SEQ ID NO:4456); miR-7075 (SEQ ID NO:4457); miR-7076 (SEQ ID NO:4458); miR-7077 (SEQ ID NO:4459); miR-7078 (SEQ ID NO:4460); miR-7079 (SEQ ID NO:4461); miR-7080 (SEQ ID NO:4462); miR-7081 (SEQ ID NO:4463); miR-7082 (SEQ ID NO:4464); miR-7083 (SEQ ID NO:4465); miR-7084 (SEQ ID NO:4466); miR-7085 (SEQ ID NO:4467); miR-7086 (SEQ ID NO:4468); miR-7087 (SEQ ID NO:4469); miR-7088 (SEQ ID NO:4470); miR-7089 (SEQ ID NO:4471); miR-7090 (SEQ ID NO:4472); miR-7091 (SEQ ID NO:4473); miR-7092 (SEQ ID NO:4474); miR-7093 (SEQ ID NO:4475); miR-7094-1 (SEQ ID NO:4476); miR-7094-2 (SEQ ID NO:4477); miR-7115 (SEQ ID NO:4478); miR-7116 (SEQ ID NO:4479); miR-7117 (SEQ ID NO:4480); miR-7118 (SEQ ID NO:4481); miR-7119 (SEQ ID NO:4482); miR-7210 (SEQ ID NO:4483); miR-7211 (SEQ ID NO:4484); miR-7212 (SEQ ID NO:4485); miR-7213 (SEQ ID NO:4486); miR-7214 (SEQ ID NO:4487); miR-7215 (SEQ ID NO:4488); miR-7216 (SEQ ID NO:4489);

miR-7217 (SEQ ID NO:4490); miR-7218 (SEQ ID NO:4491); miR-7219 (SEQ ID NO:4492); miR-7220 (SEQ ID NO:4493); miR-7221 (SEQ ID NO:4494); miR-7222 (SEQ ID NO:4495); miR-7223 (SEQ ID NO:4496); miR-7224 (SEQ ID NO:4497); miR-7225 (SEQ ID NO:4498); miR-7226 (SEQ ID NO:4499); miR-7227 (SEQ ID NO:4500); miR-7228 (SEQ ID NO:4501); miR-7229 (SEQ ID NO:4502); miR-7230 (SEQ ID NO:4503); miR-7231 (SEQ ID NO:4504); miR-7232 (SEQ ID NO:4505); miR-7233 (SEQ ID NO:4506); miR-7234 (SEQ ID NO:4507); miR-7235 (SEQ ID NO:4508); miR-7236 (SEQ ID NO:4509); miR-7237 (SEQ ID NO:4510); miR-7238 (SEQ ID NO:4511); miR-7239 (SEQ ID NO:4512); miR-7240 (SEQ ID NO:4513); miR-7241 (SEQ ID NO:4514); miR-7242 (SEQ ID NO:4515); miR-7243 (SEQ ID NO:4516); miR-7578 (SEQ ID NO:4517); miR-7646 (SEQ ID NO:4518); miR-7647 (SEQ ID NO:4519); miR-7648 (SEQ ID NO:4520); miR-7649 (SEQ ID NO:4521); miR-7650 (SEQ ID NO:4522); miR-7651 (SEQ ID NO:4523); miR-7652 (SEQ ID NO:4524); miR-7653 (SEQ ID NO:4525); miR-7654 (SEQ ID NO:4526); miR-7655 (SEQ ID NO:4527); miR-7656 (SEQ ID NO:4528); miR-7657 (SEQ ID NO:4529); miR-7658 (SEQ ID NO:4530); miR-7659 (SEQ ID NO:4531); miR-7660 (SEQ ID NO:4532); miR-7661 (SEQ ID NO:4533); miR-7662 (SEQ ID NO:4534); miR-7663 (SEQ ID NO:4535); miR-7664 (SEQ ID NO:4536); miR-7665 (SEQ ID NO:4537); miR-7666 (SEQ ID NO:4538); miR-7667 (SEQ ID NO:4539); miR-7668 (SEQ ID NO:4540); miR-7669 (SEQ ID NO:4541); miR-7670 (SEQ ID NO:4542); miR-7671 (SEQ ID NO:4543); miR-7672 (SEQ ID NO:4544); miR-7673 (SEQ ID NO:4545); miR-7674 (SEQ ID NO:4546); miR-7675 (SEQ ID NO:4547); miR-7676-1 (SEQ ID NO:4548); miR-7676-2 (SEQ ID NO:4549); miR-7677 (SEQ ID NO:4550); miR-7678 (SEQ ID NO:4551); miR-7679 (SEQ ID NO:4552); miR-7680 (SEQ ID NO:4553); miR-7681 (SEQ ID NO:4554); miR-7682 (SEQ ID NO:4555); miR-7683 (SEQ ID NO:4556); miR-7684 (SEQ ID NO:4557); miR-7685 (SEQ ID NO:4558); miR-7686 (SEQ ID NO:4559); miR-7687 (SEQ ID NO:4560); miR-7688 (SEQ ID NO:4561); miR-7689 (SEQ ID NO:4562); miR-8090 (SEQ ID NO:4563); miR-8091 (SEQ ID NO:4564); miR-8092 (SEQ ID NO:4565); miR-8093 (SEQ ID NO:4566); miR-8094 (SEQ ID NO:4567); miR-8095 (SEQ ID NO:4568); miR-8096 (SEQ ID NO:4569); miR-8097 (SEQ ID NO:4570); miR-8098 (SEQ ID NO:4571); miR-8099-1 (SEQ ID NO:4572); miR-8099-2 (SEQ ID NO:4573); miR-8100 (SEQ ID NO:4574); miR-8101 (SEQ ID NO:4575); miR-8102 (SEQ ID NO:4576); miR-8103 (SEQ ID NO:4577); miR-8104 (SEQ ID NO:4578); miR-8105 (SEQ ID NO:4579); miR-8106 (SEQ ID NO:4580); miR-8107 (SEQ ID NO:4581); miR-8108 (SEQ ID NO:4582); miR-8109 (SEQ ID NO:4583); miR-8110 (SEQ ID NO:4584); miR-8111 (SEQ ID NO:4585); miR-8112 (SEQ ID NO:4586); miR-8113 (SEQ ID NO:4587); miR-8114 (SEQ ID NO:4588); miR-8115 (SEQ ID NO:4589); miR-8116 (SEQ ID NO:4590); miR-8117 (SEQ ID NO:4591); miR-8118 (SEQ ID NO:4592); miR-8119 (SEQ ID NO:4593); and miR-8120 (SEQ ID NO:4594).

The following rat miRNAs could be used: let-7a-1 (SEQ ID NO:4595); let-7a-2 (SEQ ID NO:4596); let-7b (SEQ ID NO:4597); let-7c-1 (SEQ ID NO:4598); let-7c-2 (SEQ ID NO:4599); let-7d (SEQ ID NO:4600); let-7e (SEQ ID NO:4601); let-7f-1 (SEQ ID NO:4602); let-7f-2 (SEQ ID NO:4603); let-7i (SEQ ID NO:4604); miR-1 (SEQ ID NO:4605); miR-7a-1 (SEQ ID NO:4606); miR-7a-2 (SEQ ID NO:4607); miR-7b (SEQ ID NO:4608); miR-9a-1 (SEQ ID NO:4609); miR-9a-2 (SEQ ID NO:4610); miR-9a-3 (SEQ ID NO:4611); miR-9b-1 (SEQ ID NO:4612); miR-9b-2 (SEQ ID NO:4613); miR-9b-3 (SEQ ID NO:4614); miR-10a (SEQ ID NO:4615); miR-10b (SEQ ID NO:4616); miR-15b (SEQ ID NO:4617); miR-16 (SEQ ID NO:4618); miR-17-1 (SEQ ID NO:4619); miR-17-2 (SEQ ID NO:4620); miR-18a (SEQ ID NO:4621); miR-19a (SEQ ID NO:4622); miR-19b-1 (SEQ ID NO:4623); miR-19b-2 (SEQ ID NO:4624); miR-20a (SEQ ID NO:4625); miR-20b (SEQ ID NO:4626); miR-21 (SEQ ID NO:4627); miR-22 (SEQ ID NO:4628); miR-23a (SEQ ID NO:4629); miR-23b (SEQ ID NO:4630); miR-24-1 (SEQ ID NO:4631); miR-24-2 (SEQ ID NO:4632); miR-25 (SEQ ID NO:4633); miR-26a (SEQ ID NO:4634); miR-26b (SEQ ID NO:4635); miR-27a (SEQ ID NO:4636); miR-27b (SEQ ID NO:4637); miR-28 (SEQ ID NO:4638); miR-29a (SEQ ID NO:4639); miR-29b-1 (SEQ ID NO:4640); miR-29b-2 (SEQ ID NO:4641); miR-29c (SEQ ID NO:4642); miR-30a (SEQ ID NO:4643); miR-30b (SEQ ID NO:4644); miR-30c-1 (SEQ ID NO:4645); miR-30c-2 (SEQ ID NO:4646); miR-30d (SEQ ID NO:4647); miR-30e (SEQ ID NO:4648); miR-31a (SEQ ID NO:4649); miR-31b (SEQ ID NO:4650); miR-32 (SEQ ID NO:4651); miR-33 (SEQ ID NO:4652); miR-34a (SEQ ID NO:4653); miR-34b (SEQ ID NO:4654); miR-34c (SEQ ID NO:4655); miR-92a-1 (SEQ ID NO:4656); miR-92a-2 (SEQ ID NO:4657); miR-92b (SEQ ID NO:4658); miR-93 (SEQ ID NO:4659); miR-96 (SEQ ID NO:4660); miR-98 (SEQ ID NO:4661); miR-99a (SEQ ID NO:4662); miR-99b (SEQ ID NO:4663); miR-100 (SEQ ID NO:4664); miR-101a (SEQ ID NO:4665); miR-101b (SEQ ID NO:4666); miR-103-1 (SEQ ID NO:4667); miR-103-2 (SEQ ID NO:4668); miR-105 (SEQ ID NO:4669); miR-106b (SEQ ID NO:4670); miR-107 (SEQ ID NO:4671); miR-122 (SEQ ID NO:4672); miR-124-1 (SEQ ID NO:4673); miR-124-2 (SEQ ID NO:4674); miR-124-3 (SEQ ID NO:4675); miR-125a (SEQ ID NO:4676); miR-125b-1 (SEQ ID NO:4677); miR-125b-2 (SEQ ID NO:4678); miR-126a (SEQ ID NO:4679); miR-126b (SEQ ID NO:4680); miR-127 (SEQ ID NO:4681); miR-128-1 (SEQ ID NO:4682); miR-128-2 (SEQ ID NO:4683); miR-129-1 (SEQ ID NO:4684); miR-129-2 (SEQ ID NO:4685); miR-130a (SEQ ID NO:4686); miR-130b (SEQ ID NO:4687); miR-132 (SEQ ID NO:4688); miR-133a (SEQ ID NO:4689); miR-133b (SEQ ID NO:4690); miR-133c (SEQ ID NO:4691); miR-134 (SEQ ID NO:4692); miR-135a (SEQ ID NO:4693); miR-135b (SEQ ID NO:4694); miR-136 (SEQ ID NO:4695); miR-137 (SEQ ID NO:4696); miR-138-1 (SEQ ID NO:4697); miR-138-2 (SEQ ID NO:4698); miR-139 (SEQ ID NO:4699); miR-140 (SEQ ID NO:4700); miR-141 (SEQ ID NO:4701); miR-142 (SEQ ID NO:4702); miR-143 (SEQ ID NO:4703); miR-144 (SEQ ID NO:4704); miR-145 (SEQ ID NO:4705); miR-146a (SEQ ID NO:4706); miR-146b (SEQ ID NO:4707); miR-147 (SEQ ID NO:4708); miR-148b (SEQ ID NO:4709); miR-150 (SEQ ID NO:4710); miR-151 (SEQ ID NO:4711); miR-152 (SEQ ID NO:4712); miR-153 (SEQ ID NO:4713); miR-154 (SEQ ID NO:4714); miR-155 (SEQ ID NO:4715); miR-181a-1 (SEQ ID NO:4716); miR-181a-2 (SEQ ID NO:4717); miR-181b-1 (SEQ ID NO:4718); miR-181b-2 (SEQ ID NO:4719); miR-181c (SEQ ID NO:4720); miR-181d (SEQ ID NO:4721); miR-182 (SEQ ID NO:4722); miR-183 (SEQ ID NO:4723); miR-184 (SEQ ID NO:4724); miR-185 (SEQ ID NO:4725); miR-186 (SEQ ID NO:4726); miR-187 (SEQ ID NO:4727); miR-188 (SEQ ID NO:4728); miR-190a (SEQ ID NO:4729); miR-190b (SEQ ID NO:4730); miR-191a (SEQ ID NO:4731); miR-191b (SEQ ID NO:4732); miR-192 (SEQ ID NO:4733); miR-193 (SEQ ID NO:4734); miR-194-1 (SEQ ID NO:4735); miR-194-2 (SEQ ID NO:4736); miR-195

(SEQ ID NO:4737); miR-196a (SEQ ID NO:4738); miR-196b (SEQ ID NO:4739); miR-196c (SEQ ID NO:4740); miR-199a (SEQ ID NO:4741); miR-200a (SEQ ID NO:4742); miR-200b (SEQ ID NO:4743); miR-200c (SEQ ID NO:4744); miR-201 (SEQ ID NO:4745); miR-202 (SEQ ID NO:4746); miR-203a (SEQ ID NO:4747); miR-203b (SEQ ID NO:4748); miR-204 (SEQ ID NO:4749); miR-205 (SEQ ID NO:4750); miR-206 (SEQ ID NO:4751); miR-207 (SEQ ID NO:4752); miR-208a (SEQ ID NO:4753); miR-208b (SEQ ID NO:4754); miR-210 (SEQ ID NO:4755); miR-211 (SEQ ID NO:4756); miR-212 (SEQ ID NO:4757); miR-214 (SEQ ID NO:4758); miR-215 (SEQ ID NO:4759); miR-216a (SEQ ID NO:4760); miR-216b (SEQ ID NO:4761); miR-217 (SEQ ID NO:4762); miR-218a-1 (SEQ ID NO:4763); miR-218a-2 (SEQ ID NO:4764); miR-218b (SEQ ID NO:4765); miR-219a-1 (SEQ ID NO:4766); miR-219a-2 (SEQ ID NO:4767); miR-219b (SEQ ID NO:4768); miR-221 (SEQ ID NO:4769); miR-222 (SEQ ID NO:4770); miR-223 (SEQ ID NO:4771); miR-224 (SEQ ID NO:4772); miR-290 (SEQ ID NO:4773); miR-291a (SEQ ID NO:4774); miR-291b (SEQ ID NO:4775); miR-292 (SEQ ID NO:4776); miR-293 (SEQ ID NO:4777); miR-294 (SEQ ID NO:4778); miR-295-1 (SEQ ID NO:4779); miR-295-2 (SEQ ID NO:4780); miR-296 (SEQ ID NO:4781); miR-297 (SEQ ID NO:4782); miR-298 (SEQ ID NO:4783); miR-299a (SEQ ID NO:4784); miR-299b (SEQ ID NO:4785); miR-300 (SEQ ID NO:4786); miR-301a (SEQ ID NO:4787); miR-301b (SEQ ID NO:4788); miR-320 (SEQ ID NO:4789); miR-322 (SEQ ID NO:4790); miR-323 (SEQ ID NO:4791); miR-324 (SEQ ID NO:4792); miR-325 (SEQ ID NO:4793); miR-326 (SEQ ID NO:4794); miR-327 (SEQ ID NO:4795); miR-328a (SEQ ID NO:4796); miR-328b (SEQ ID NO:4797); miR-329 (SEQ ID NO:4798); miR-330 (SEQ ID NO:4799); miR-331 (SEQ ID NO:4800); miR-335 (SEQ ID NO:4801); miR-336 (SEQ ID NO:4802); miR-337 (SEQ ID NO:4803); miR-338 (SEQ ID NO:4804); miR-339 (SEQ ID NO:4805); miR-340 (SEQ ID NO:4806); miR-341 (SEQ ID NO:4807); miR-342 (SEQ ID NO:4808); miR-343 (SEQ ID NO:4809); miR-344a-1 (SEQ ID NO:4810); miR-344a-2 (SEQ ID NO:4811); miR-344b-1 (SEQ ID NO:4812); miR-344b-2 (SEQ ID NO:4813); miR-344g (SEQ ID NO:4814); miR-344i (SEQ ID NO:4815); miR-345 (SEQ ID NO:4816); miR-346 (SEQ ID NO:4817); miR-347 (SEQ ID NO:4818); miR-349 (SEQ ID NO:4819); miR-350 (SEQ ID NO:4820); miR-351 (SEQ ID NO:4821); miR-352 (SEQ ID NO:4822); miR-361 (SEQ ID NO:4823); miR-362 (SEQ ID NO:4824); miR-363 (SEQ ID NO:4825); miR-365 (SEQ ID NO:4826); miR-369 (SEQ ID NO:4827); miR-370 (SEQ ID NO:4828); miR-374 (SEQ ID NO:4829); miR-375 (SEQ ID NO:4830); miR-376a (SEQ ID NO:4831); miR-376b (SEQ ID NO:4832); miR-376c (SEQ ID NO:4833); miR-377 (SEQ ID NO:4834); miR-378a (SEQ ID NO:4835); miR-378b (SEQ ID NO:4836); miR-379 (SEQ ID NO:4837); miR-380 (SEQ ID NO:4838); miR-381 (SEQ ID NO:4839); miR-382 (SEQ ID NO:4840); miR-383 (SEQ ID NO:4841); miR-384 (SEQ ID NO:4842); miR-409a (SEQ ID NO:4843); miR-409b (SEQ ID NO:4844); miR-410 (SEQ ID NO:4845); miR-411 (SEQ ID NO:4846); miR-412 (SEQ ID NO:4847); miR-421 (SEQ ID NO:4848); miR-423 (SEQ ID NO:4849); miR-425 (SEQ ID NO:4850); miR-429 (SEQ ID NO:4851); miR-431 (SEQ ID NO:4852); miR-433 (SEQ ID NO:4853); miR-434 (SEQ ID NO:4854); miR-448 (SEQ ID NO:4855); miR-449a (SEQ ID NO:4856); miR-449c (SEQ ID NO:4857); miR-450a (SEQ ID NO:4858); miR-451 (SEQ ID NO:4859); miR-455 (SEQ ID NO:4860); miR-463 (SEQ ID NO:4861); miR-465 (SEQ ID NO:4862); miR-466-1 (SEQ ID NO:4863); miR-466b-2 (SEQ ID NO:4864); miR-466c (SEQ ID NO:4865); miR-466d (SEQ ID NO:4866); miR-471 (SEQ ID NO:4867); miR-483 (SEQ ID NO:4868); miR-484 (SEQ ID NO:4869); miR-485 (SEQ ID NO:4870); miR-487b (SEQ ID NO:4871); miR-488 (SEQ ID NO:4872); miR-489 (SEQ ID NO:4873); miR-490 (SEQ ID NO:4874); miR-493 (SEQ ID NO:4875); miR-494 (SEQ ID NO:4876); miR-495 (SEQ ID NO:4877); miR-496 (SEQ ID NO:4878); miR-497 (SEQ ID NO:4879); miR-499 (SEQ ID NO:4880); miR-500 (SEQ ID NO:4881); miR-501 (SEQ ID NO:4882); miR-503 (SEQ ID NO:4883); miR-504 (SEQ ID NO:4884); miR-505 (SEQ ID NO:4885); miR-509 (SEQ ID NO:4886); miR-511 (SEQ ID NO:4887); miR-532 (SEQ ID NO:4888); miR-539 (SEQ ID NO:4889); miR-540 (SEQ ID NO:4890); miR-541 (SEQ ID NO:4891); miR-542 (SEQ ID NO:4892); miR-543 (SEQ ID NO:4893); miR-544 (SEQ ID NO:4894); miR-547 (SEQ ID NO:4895); miR-551b (SEQ ID NO:4896); miR-568 (SEQ ID NO:4897); miR-582 (SEQ ID NO:4898); miR-592 (SEQ ID NO:4899); miR-598 (SEQ ID NO:4900); miR-615 (SEQ ID NO:4901); miR-628 (SEQ ID NO:4902); miR-632 (SEQ ID NO:4903); miR-652 (SEQ ID NO:4904); miR-653 (SEQ ID NO:4905); miR-664-1 (SEQ ID NO:4906); miR-664-2 (SEQ ID NO:4907); miR-665 (SEQ ID NO:4908); miR-666 (SEQ ID NO:4909); miR-667 (SEQ ID NO:4910); miR-668 (SEQ ID NO:4911); miR-671 (SEQ ID NO:4912); miR-672 (SEQ ID NO:4913); miR-673 (SEQ ID NO:4914); miR-674 (SEQ ID NO:4915); miR-675 (SEQ ID NO:4916); miR-678 (SEQ ID NO:4917); miR-679 (SEQ ID NO:4918); miR-702 (SEQ ID NO:4919); miR-708 (SEQ ID NO:4920); miR-711 (SEQ ID NO:4921); miR-741 (SEQ ID NO:4922); miR-742 (SEQ ID NO:4923); miR-743a (SEQ ID NO:4924); miR-743b (SEQ ID NO:4925); miR-758 (SEQ ID NO:4926); miR-759 (SEQ ID NO:4927); miR-760 (SEQ ID NO:4928); miR-761 (SEQ ID NO:4929); miR-764 (SEQ ID NO:4930); miR-770 (SEQ ID NO:4931); miR-802 (SEQ ID NO:4932); miR-871 (SEQ ID NO:4933); miR-872 (SEQ ID NO:4934); miR-873 (SEQ ID NO:4935); miR-874 (SEQ ID NO:4936); miR-875 (SEQ ID NO:4937); miR-876 (SEQ ID NO:4938); miR-877 (SEQ ID NO:4939); miR-878 (SEQ ID NO:4940); miR-879 (SEQ ID NO:4941); miR-880 (SEQ ID NO:4942); miR-881 (SEQ ID NO:4943); miR-883 (SEQ ID NO:4944); miR-935 (SEQ ID NO:4945); miR-1188 (SEQ ID NO:4946); miR-1193 (SEQ ID NO:4947); miR-1199 (SEQ ID NO:4948); miR-1224 (SEQ ID NO:4949); miR-1249 (SEQ ID NO:4950); miR-1298 (SEQ ID NO:4951); miR-1306 (SEQ ID NO:4952); miR-1839 (SEQ ID NO:4953); miR-1843 (SEQ ID NO:4954); miR-1912 (SEQ ID NO:4955); miR-1949 (SEQ ID NO:4956); miR-2985 (SEQ ID NO:4957); miR-3065 (SEQ ID NO:4958); miR-3068 (SEQ ID NO:4959); miR-3072 (SEQ ID NO:4960); miR-3074 (SEQ ID NO:4961); miR-3075 (SEQ ID NO:4962); miR-3085 (SEQ ID NO:4963); miR-3099 (SEQ ID NO:4964); miR-3102 (SEQ ID NO:4965); miR-3120 (SEQ ID NO:4966); miR-3473 (SEQ ID NO:4967); miR-3541 (SEQ ID NO:4968); miR-3542 (SEQ ID NO:4969); miR-3543 (SEQ ID NO:4970); miR-3544 (SEQ ID NO:4971); miR-3546 (SEQ ID NO:4972); miR-3547 (SEQ ID NO:4973); miR-3548 (SEQ ID NO:4974); miR-3549 (SEQ ID NO:4975); miR-3550 (SEQ ID NO:4976); miR-3551 (SEQ ID NO:4977); miR-3552 (SEQ ID NO:4978); miR-3553 (SEQ ID NO:4979); miR-3556a (SEQ ID NO:4980); miR-3556b (SEQ ID NO:4981); miR-3557 (SEQ ID NO:4982); miR-3558 (SEQ ID NO:4983); miR-3559 (SEQ ID NO:4984); miR-3560 (SEQ ID NO:4985); miR-3561 (SEQ ID NO:4986); miR-3562 (SEQ ID NO:4987); miR-3564 (SEQ ID NO:4988); miR-3566 (SEQ ID NO:4989); miR-3568 (SEQ ID NO:4990); miR-3569 (SEQ ID NO:4991); miR-3570 (SEQ ID NO:4992); miR-3571 (SEQ ID NO:4993); miR-3572 (SEQ ID NO:4994);

miR-3573 (SEQ ID NO:4995); miR-3574 (SEQ ID NO:4996); miR-3575 (SEQ ID NO:4997); miR-3576 (SEQ ID NO:4998); miR-3577 (SEQ ID NO:4999); miR-3578 (SEQ ID NO:5000); miR-3579 (SEQ ID NO:5001); miR-3580 (SEQ ID NO:5002); miR-3583 (SEQ ID NO:5003); miR-3584 (SEQ ID NO:5004); miR-3585 (SEQ ID NO:5005); miR-3586 (SEQ ID NO:5006); miR-3587 (SEQ ID NO:5007); miR-3588 (SEQ ID NO:5008); miR-3589 (SEQ ID NO:5009); miR-3590 (SEQ ID NO:5010); miR-3591 (SEQ ID NO:5011); miR-3592 (SEQ ID NO:5012); miR-3593 (SEQ ID NO:5013); miR-3594 (SEQ ID NO:5014); miR-3595 (SEQ ID NO:5015); miR-3596a (SEQ ID NO:5016); miR-3596b (SEQ ID NO:5017); miR-3596c (SEQ ID NO:5018); miR-3596d (SEQ ID NO:5019); miR-6215 (SEQ ID NO:5020); miR-6216 (SEQ ID NO:5021); miR-6314 (SEQ ID NO:5022); miR-6315 (SEQ ID NO:5023); miR-6316 (SEQ ID NO:5024); miR-6317 (SEQ ID NO:5025); miR-6318 (SEQ ID NO:5026); miR-6319 (SEQ ID NO:5027); miR-6320 (SEQ ID NO:5028); miR-6321 (SEQ ID NO:5029); miR-6322 (SEQ ID NO:5030); miR-6323 (SEQ ID NO:5031); miR-6324 (SEQ ID NO:5032); miR-6325 (SEQ ID NO:5033); miR-6326 (SEQ ID NO:5034); miR-6327 (SEQ ID NO:5035); miR-6328 (SEQ ID NO:5036); miR-6329 (SEQ ID NO:5037); miR-6330 (SEQ ID NO:5038); miR-6331 (SEQ ID NO:5039); miR-6332 (SEQ ID NO:5040); miR-6333 (SEQ ID NO:5041); miR-6334 (SEQ ID NO:5042); and miR-7578 (SEQ ID NO:5043).

The following fruit fly miRNAs could be used: bantam (SEQ ID NO:5044); let-7 (SEQ ID NO:5045); miR-1 (SEQ ID NO:5046); miR-2a-1 (SEQ ID NO:5047); miR-2a-2 (SEQ ID NO:5048); miR-2b-1 (SEQ ID NO:5049); miR-2b-2 (SEQ ID NO:5050); miR-2c (SEQ ID NO:5051); miR-3 (SEQ ID NO:5052); miR-4 (SEQ ID NO:5053); miR-5 (SEQ ID NO:5054); miR-6-1 (SEQ ID NO:5055); miR-6-2 (SEQ ID NO:5056); miR-6-3 (SEQ ID NO:5057); miR-7 (SEQ ID NO:5058); miR-8 (SEQ ID NO:5059); miR-9a (SEQ ID NO:5060); miR-9b (SEQ ID NO:5061); miR-9c (SEQ ID NO:5062); miR-10 (SEQ ID NO:5063); miR-11 (SEQ ID NO:5064); miR-12 (SEQ ID NO:5065); miR-13a (SEQ ID NO:5066); miR-13b-1 (SEQ ID NO:5067); miR-13b-2 (SEQ ID NO:5068); miR-14 (SEQ ID NO:5069); miR-31a (SEQ ID NO:5070); miR-31b (SEQ ID NO:5071); miR-33 (SEQ ID NO:5072); miR-34 (SEQ ID NO:5073); miR-79 (SEQ ID NO:5074); miR-87 (SEQ ID NO:5075); miR-92a (SEQ ID NO:5076); miR-92b (SEQ ID NO:5077); miR-100 (SEQ ID NO:5078); miR-124 (SEQ ID NO:5079); miR-125 (SEQ ID NO:5080); miR-133 (SEQ ID NO:5081); miR-137 (SEQ ID NO:5082); miR-184 (SEQ ID NO:5083); miR-190 (SEQ ID NO:5084); miR-193 (SEQ ID NO:5085); miR-210 (SEQ ID NO:5086); miR-219 (SEQ ID NO:5087); miR-252 (SEQ ID NO:5088); miR-263a (SEQ ID NO:5089); miR-263b (SEQ ID NO:5090); miR-274 (SEQ ID NO:5091); miR-275 (SEQ ID NO:5092); miR-276a (SEQ ID NO:5093); miR-276b (SEQ ID NO:5094); miR-277 (SEQ ID NO:5095); miR-278 (SEQ ID NO:5096); miR-279 (SEQ ID NO:5097); miR-280 (SEQ ID NO:5098); miR-281-1 (SEQ ID NO:5099); miR-281-2 (SEQ ID NO:5100); miR-282 (SEQ ID NO:5101); miR-283 (SEQ ID NO:5102); miR-284 (SEQ ID NO:5103); miR-285 (SEQ ID NO:5104); miR-286 (SEQ ID NO:5105); miR-287 (SEQ ID NO:5106); miR-288 (SEQ ID NO:5107); miR-289 (SEQ ID NO:5108); miR-303 (SEQ ID NO:5109); miR-304 (SEQ ID NO:5110); miR-305 (SEQ ID NO:5111); miR-306 (SEQ ID NO:5112); miR-307a (SEQ ID NO:5113); miR-307b (SEQ ID NO:5114); miR-308 (SEQ ID NO:5115); miR-309 (SEQ ID NO:5116); miR-310 (SEQ ID NO:5117); miR-311 (SEQ ID NO:5118); miR-312 (SEQ ID NO:5119); miR-313 (SEQ ID NO:5120); miR-314 (SEQ ID NO:5121); miR-315 (SEQ ID NO:5122); miR-316 (SEQ ID NO:5123); miR-317 (SEQ ID NO:5124); miR-318 (SEQ ID NO:5125); miR-375 (SEQ ID NO:5126); miR-927 (SEQ ID NO:5127); miR-929 (SEQ ID NO:5128); miR-932 (SEQ ID NO:5129); miR-954 (SEQ ID NO:5130); miR-955 (SEQ ID NO:5131); miR-956 (SEQ ID NO:5132); miR-957 (SEQ ID NO:5133); miR-958 (SEQ ID NO:5134); miR-959 (SEQ ID NO:5135); miR-960 (SEQ ID NO:5136); miR-961 (SEQ ID NO:5137); miR-962 (SEQ ID NO:5138); miR-963 (SEQ ID NO:5139); miR-964 (SEQ ID NO:5140); miR-965 (SEQ ID NO:5141); miR-966 (SEQ ID NO:5142); miR-967 (SEQ ID NO:5143); miR-968 (SEQ ID NO:5144); miR-969 (SEQ ID NO:5145); miR-970 (SEQ ID NO:5146); miR-971 (SEQ ID NO:5147); miR-972 (SEQ ID NO:5148); miR-973 (SEQ ID NO:5149); miR-974 (SEQ ID NO:5150); miR-975 (SEQ ID NO:5151); miR-976 (SEQ ID NO:5152); miR-977 (SEQ ID NO:5153); miR-978 (SEQ ID NO:5154); miR-979 (SEQ ID NO:5155); miR-980 (SEQ ID NO:5156); miR-981 (SEQ ID NO:5157); miR-982 (SEQ ID NO:5158); miR-983-1 (SEQ ID NO:5159); miR-983-2 (SEQ ID NO:5160); miR-984 (SEQ ID NO:5161); miR-985 (SEQ ID NO:5162); miR-986 (SEQ ID NO:5163); miR-987 (SEQ ID NO:5164); miR-988 (SEQ ID NO:5165); miR-989 (SEQ ID NO:5166); miR-990 (SEQ ID NO:5167); miR-991 (SEQ ID NO:5168); miR-992 (SEQ ID NO:5169); miR-993 (SEQ ID NO:5170); miR-994 (SEQ ID NO:5171); miR-995 (SEQ ID NO:5172); miR-996 (SEQ ID NO:5173); miR-997 (SEQ ID NO:5174); miR-998 (SEQ ID NO:5175); miR-999 (SEQ ID NO:5176); miR-1000 (SEQ ID NO:5177); miR-1001 (SEQ ID NO:5178); miR-1002 (SEQ ID NO:5179); miR-1003 (SEQ ID NO:5180); miR-1004 (SEQ ID NO:5181); miR-1005 (SEQ ID NO:5182); miR-1006 (SEQ ID NO:5183); miR-1007 (SEQ ID NO:5184); miR-1008 (SEQ ID NO:5185); miR-1009 (SEQ ID NO:5186); miR-1010 (SEQ ID NO:5187); miR-1011 (SEQ ID NO:5188); miR-1012 (SEQ ID NO:5189); miR-1013 (SEQ ID NO:5190); miR-1014 (SEQ ID NO:5191); miR-1015 (SEQ ID NO:5192); miR-1016 (SEQ ID NO:5193); miR-1017 (SEQ ID NO:5194); miR-2279 (SEQ ID NO:5195); miR-2280 (SEQ ID NO:5196); miR-2281 (SEQ ID NO:5197); miR-2282 (SEQ ID NO:5198); miR-2283 (SEQ ID NO:5199); miR-2489 (SEQ ID NO:5200); miR-2490 (SEQ ID NO:5201); miR-2491 (SEQ ID NO:5202); miR-2492 (SEQ ID NO:5203); miR-2493 (SEQ ID NO:5204); miR-2494 (SEQ ID NO:5205); miR-2495 (SEQ ID NO:5206); miR-2496 (SEQ ID NO:5207); miR-2497 (SEQ ID NO:5208); miR-2498 (SEQ ID NO:5209); miR-2499 (SEQ ID NO:5210); miR-2500 (SEQ ID NO:5211); miR-2501 (SEQ ID NO:5212); miR-2535b (SEQ ID NO:5213); miR-3641 (SEQ ID NO:5214); miR-3642 (SEQ ID NO:5215); miR-3643 (SEQ ID NO:5216); miR-3644 (SEQ ID NO:5217); miR-3645 (SEQ ID NO:5218); miR-4908 (SEQ ID NO:5219); miR-4909 (SEQ ID NO:5220); miR-4910 (SEQ ID NO:5221); miR-4911 (SEQ ID NO:5222); miR-4912 (SEQ ID NO:5223); miR-4913 (SEQ ID NO:5224); miR-4914 (SEQ ID NO:5225); miR-4915 (SEQ ID NO:5226); miR-4916 (SEQ ID NO:5227); miR-4917 (SEQ ID NO:5228); miR-4918 (SEQ ID NO:5229); miR-4919 (SEQ ID NO:5230); miR-4939 (SEQ ID NO:5231); miR-4940 (SEQ ID NO:5232); miR-4941 (SEQ ID NO:5233); miR-4942 (SEQ ID NO:5234); miR-4943 (SEQ ID NO:5235); miR-4944 (SEQ ID NO:5236); miR-4945 (SEQ ID NO:5237); miR-4946 (SEQ ID NO:5238); miR-4947 (SEQ ID NO:5239); miR-4948 (SEQ ID NO:5240); miR-4949 (SEQ ID NO:5241); miR-4950 (SEQ ID NO:5242); miR-4951 (SEQ ID NO:5243); miR-4952 (SEQ ID NO:5244); miR-4953 (SEQ ID NO:5245);

miR-4954 (SEQ ID NO:5246); miR-4955 (SEQ ID NO:5247); miR-4956 (SEQ ID NO:5248); miR-4957 (SEQ ID NO:5249); miR-4958 (SEQ ID NO:5250); miR-4959 (SEQ ID NO:5251); miR-4960 (SEQ ID NO:5252); miR-4961 (SEQ ID NO:5253); miR-4962 (SEQ ID NO:5254); miR-4963 (SEQ ID NO:5255); miR-4964 (SEQ ID NO:5256); miR-4965 (SEQ ID NO:5257); miR-4966 (SEQ ID NO:5258); miR-4967 (SEQ ID NO:5259); miR-4968 (SEQ ID NO:5260); miR-4969 (SEQ ID NO:5261); miR-4970 (SEQ ID NO:5262); miR-4971 (SEQ ID NO:5263); miR-4972 (SEQ ID NO:5264); miR-4973 (SEQ ID NO:5265); miR-4974 (SEQ ID NO:5266); miR-4975 (SEQ ID NO:5267); miR-4976 (SEQ ID NO:5268); miR-4977 (SEQ ID NO:5269); miR-4978 (SEQ ID NO:5270); miR-4979 (SEQ ID NO:5271); miR-4980 (SEQ ID NO:5272); miR-4981 (SEQ ID NO:5273); miR-4982 (SEQ ID NO:5274); miR-4983 (SEQ ID NO:5275); miR-4984 (SEQ ID NO:5276); miR-4985 (SEQ ID NO:5277); miR-4986 (SEQ ID NO:5278); miR-4987 (SEQ ID NO:5279); miR-iab-4 (SEQ ID NO:5280); and miR-iab-8 (SEQ ID NO:5281).

The following cow miRNA could be used: let-7a-1 (SEQ ID NO:5282); let-7a-2 (SEQ ID NO:5283); let-7a-3 (SEQ ID NO:5284); let-7b (SEQ ID NO:5285); let-7c (SEQ ID NO:5286); let-7d (SEQ ID NO:5287); let-7e (SEQ ID NO:5288); let-7f-1 (SEQ ID NO:5289); let-7f-2 (SEQ ID NO:5290); let-7g (SEQ ID NO:5291); let-7i (SEQ ID NO:5292); miR-1-1 (SEQ ID NO:5293); miR-1-2 (SEQ ID NO:5294); miR-7-1 (SEQ ID NO:5295); miR-7-2 (SEQ ID NO:5296); miR-7-3 (SEQ ID NO:5297); miR-9-1 (SEQ ID NO:5298); miR-9-2 (SEQ ID NO:5299); miR-10a (SEQ ID NO:5300); miR-10b (SEQ ID NO:5301); miR-15a (SEQ ID NO:5302); miR-15b (SEQ ID NO:5303); miR-16a (SEQ ID NO:5304); miR-16b (SEQ ID NO:5305); miR-17 (SEQ ID NO:5306); miR-18a (SEQ ID NO:5307); miR-18b (SEQ ID NO:5308); miR-19a (SEQ ID NO:5309); miR-19b (SEQ ID NO:5310); miR-19b-2 (SEQ ID NO:5311); miR-20a (SEQ ID NO:5312); miR-20b (SEQ ID NO:5313); miR-21 (SEQ ID NO:5314); miR-22 (SEQ ID NO:5315); miR-23a (SEQ ID NO:5316); miR-23b (SEQ ID NO:5317); miR-24-1 (SEQ ID NO:5318); miR-24-2 (SEQ ID NO:5319); miR-25 (SEQ ID NO:5320); miR-26a-1 (SEQ ID NO:5321); miR-26a-2 (SEQ ID NO:5322); miR-26b (SEQ ID NO:5323); miR-26c (SEQ ID NO:5324); miR-27a (SEQ ID NO:5325); miR-27b (SEQ ID NO:5326); miR-28 (SEQ ID NO:5327); miR-29a (SEQ ID NO:5328); miR-29b-1 (SEQ ID NO:5329); miR-29b-2 (SEQ ID NO:5330); miR-29c (SEQ ID NO:5331); miR-29d (SEQ ID NO:5332); miR-29e (SEQ ID NO:5333); miR-30a (SEQ ID NO:5334); miR-30b (SEQ ID NO:5335); miR-30c (SEQ ID NO:5336); miR-30d (SEQ ID NO:5337); miR-30e (SEQ ID NO:5338); miR-30f (SEQ ID NO:5339); miR-31 (SEQ ID NO:5340); miR-32 (SEQ ID NO:5341); miR-33a (SEQ ID NO:5342); miR-33b (SEQ ID NO:5343); miR-34a (SEQ ID NO:5344); miR-34b (SEQ ID NO:5345); miR-34c (SEQ ID NO:5346); miR-92a-1 (SEQ ID NO:5347); miR-92a-2 (SEQ ID NO:5348); miR-92b (SEQ ID NO:5349); miR-93 (SEQ ID NO:5350); miR-95 (SEQ ID NO:5351); miR-96 (SEQ ID NO:5352); miR-98 (SEQ ID NO:5353); miR-99a (SEQ ID NO:5354); miR-99b (SEQ ID NO:5355); miR-100 (SEQ ID NO:5356); miR-101-1 (SEQ ID NO:5357); miR-101-2 (SEQ ID NO:5358); miR-103-1 (SEQ ID NO:5359); miR-103-2 (SEQ ID NO:5360); miR-105a (SEQ ID NO:5361); miR-105b (SEQ ID NO:5362); miR-106a (SEQ ID NO:5363); miR-106b (SEQ ID NO:5364); miR-107 (SEQ ID NO:5365); miR-122 (SEQ ID NO:5366); miR-124a-1 (SEQ ID NO:5367); miR-124a-2 (SEQ ID NO:5368); miR-124b (SEQ ID NO:5369); miR-125a (SEQ ID NO:5370); miR-125b-1 (SEQ ID NO:5371); miR-125b-2 (SEQ ID NO:5372); miR-126 (SEQ ID NO:5373); miR-127 (SEQ ID NO:5374); miR-128-1 (SEQ ID NO:5375); miR-128-2 (SEQ ID NO:5376); miR-129-1 (SEQ ID NO:5377); miR-129-2 (SEQ ID NO:5378); miR-130a (SEQ ID NO:5379); miR-130b (SEQ ID NO:5380); miR-132 (SEQ ID NO:5381); miR-133a-1 (SEQ ID NO:5382); miR-133a-2 (SEQ ID NO:5383); miR-133b (SEQ ID NO:5384); miR-133c (SEQ ID NO:5385); miR-134 (SEQ ID NO:5386); miR-135a-1 (SEQ ID NO:5387); miR-135a-2 (SEQ ID NO:5388); miR-135b (SEQ ID NO:5389); miR-136 (SEQ ID NO:5390); miR-137 (SEQ ID NO:5391); miR-138-1 (SEQ ID NO:5392); miR-138-2 (SEQ ID NO:5393); miR-139 (SEQ ID NO:5394); miR-140 (SEQ ID NO:5395); miR-141 (SEQ ID NO:5396); miR-142 (SEQ ID NO:5397); miR-143 (SEQ ID NO:5398); miR-144 (SEQ ID NO:5399); miR-145 (SEQ ID NO:5400); miR-146a (SEQ ID NO:5401); miR-146b (SEQ ID NO:5402); miR-147 (SEQ ID NO:5403); miR-148a (SEQ ID NO:5404); miR-148b (SEQ ID NO:5405); miR-149 (SEQ ID NO:5406); miR-150 (SEQ ID NO:5407); miR-151 (SEQ ID NO:5408); miR-152 (SEQ ID NO:5409); miR-153-1 (SEQ ID NO:5410); miR-153-2 (SEQ ID NO:5411); miR-154a (SEQ ID NO:5412); miR-154b (SEQ ID NO:5413); miR-154c (SEQ ID NO:5414); miR-155 (SEQ ID NO:5415); miR-181a-1 (SEQ ID NO:5416); miR-181a-2 (SEQ ID NO:5417); miR-181b-1 (SEQ ID NO:5418); miR-181b-2 (SEQ ID NO:5419); miR-181c (SEQ ID NO:5420); miR-181d (SEQ ID NO:5421); miR-182 (SEQ ID NO:5422); miR-183 (SEQ ID NO:5423); miR-184 (SEQ ID NO:5424); miR-185 (SEQ ID NO:5425); miR-186 (SEQ ID NO:5426); miR-187 (SEQ ID NO:5427); miR-188 (SEQ ID NO:5428); miR-190a (SEQ ID NO:5429); miR-190b (SEQ ID NO:5430); miR-191 (SEQ ID NO:5431); miR-192 (SEQ ID NO:5432); miR-193a (SEQ ID NO:5433); miR-193a-2 (SEQ ID NO:5434); miR-193b (SEQ ID NO:5435); miR-194-1 (SEQ ID NO:5436); miR-194-2 (SEQ ID NO:5437); miR-195 (SEQ ID NO:5438); miR-196a-1 (SEQ ID NO:5439); miR-196a-2 (SEQ ID NO:5440); miR-196b (SEQ ID NO:5441); miR-197 (SEQ ID NO:5442); miR-199a-1 (SEQ ID NO:5443); miR-199a-2 (SEQ ID NO:5444); miR-199b (SEQ ID NO:5445); miR-199c (SEQ ID NO:5446); miR-200a (SEQ ID NO:5447); miR-200b (SEQ ID NO:5448); miR-200c (SEQ ID NO:5449); miR-202 (SEQ ID NO:5450); miR-204 (SEQ ID NO:5451); miR-205 (SEQ ID NO:5452); miR-206 (SEQ ID NO:5453); miR-208a (SEQ ID NO:5454); miR-208b (SEQ ID NO:5455); miR-210 (SEQ ID NO:5456); miR-211 (SEQ ID NO:5457); miR-212 (SEQ ID NO:5458); miR-214 (SEQ ID NO:5459); miR-215 (SEQ ID NO:5460); miR-216a (SEQ ID NO:5461); miR-216b (SEQ ID NO:5462); miR-217 (SEQ ID NO:5463); miR-218-1 (SEQ ID NO:5464); miR-218-2 (SEQ ID NO:5465); miR-219 (SEQ ID NO:5466); miR-219-2 (SEQ ID NO:5467); miR-221 (SEQ ID NO:5468); miR-222 (SEQ ID NO:5469); miR-223 (SEQ ID NO:5470); miR-224 (SEQ ID NO:5471); miR-296 (SEQ ID NO:5472); miR-299 (SEQ ID NO:5473); miR-301a (SEQ ID NO:5474); miR-301b (SEQ ID NO:5475); miR-302a (SEQ ID NO:5476); miR-302b (SEQ ID NO:5477); miR-302c (SEQ ID NO:5478); miR-302d (SEQ ID NO:5479); miR-320a-1 (SEQ ID NO:5480); miR-320a-2 (SEQ ID NO:5481); miR-320b (SEQ ID NO:5482); miR-323 (SEQ ID NO:5483); miR-324 (SEQ ID NO:5484); miR-326 (SEQ ID NO:5485); miR-328 (SEQ ID NO:5486); miR-329a (SEQ ID NO:5487); miR-329b (SEQ ID NO:5488); miR-330 (SEQ ID NO:5489); miR-331 (SEQ ID NO:5490); miR-335 (SEQ ID NO:5491); miR-338 (SEQ ID NO:5492); miR-339a (SEQ ID NO:5493); miR-339b (SEQ ID NO:5494); miR-340 (SEQ ID NO:5495); miR-342 (SEQ ID NO:5496); miR-345 (SEQ ID NO:5497); miR-346 (SEQ ID NO:5498); miR-361 (SEQ ID NO:5499); miR-362 (SEQ ID NO:5500); miR-363 (SEQ ID NO:5501); miR-365-1 (SEQ ID NO:5502); miR-365-2 (SEQ ID NO:5503); miR-367 (SEQ ID NO:5504); miR-369 (SEQ ID NO:5505); miR-370 (SEQ ID NO:5506); miR-371 (SEQ ID NO:5507); miR-374a (SEQ ID NO:5508); miR-374b (SEQ ID NO:5509); miR-375 (SEQ ID NO:5510); miR-376a (SEQ ID NO:5511); miR-376b (SEQ ID NO:5512); miR-376c (SEQ ID NO:5513); miR-376d (SEQ ID NO:5514); miR-376e (SEQ ID NO:5515); miR-377 (SEQ ID NO:5516); miR-378-1 (SEQ ID NO:5517); miR-378-2 (SEQ ID NO:5518); miR-378b (SEQ ID NO:5519); miR-378c (SEQ ID NO:5520); miR-379 (SEQ ID NO:5521); miR-380 (SEQ ID NO:5522); miR-381 (SEQ ID NO:5523); miR-382 (SEQ ID NO:5524); miR-383 (SEQ ID NO:5525); miR-409a (SEQ ID NO:5526); miR-409b (SEQ ID NO:5527); miR-410 (SEQ ID NO:5528); miR-411a (SEQ ID NO:5529); miR-411b (SEQ ID NO:5530); miR-411c (SEQ ID NO:5531); miR-412 (SEQ ID NO:5532); miR-421 (SEQ ID NO:5533); miR-423 (SEQ ID NO:5534); miR-424 (SEQ ID NO:5535); miR-425 (SEQ ID NO:5536); miR-429 (SEQ ID NO:5537); miR-431 (SEQ ID NO:5538); miR-432 (SEQ ID NO:5539); miR-433 (SEQ ID NO:5540); miR-448 (SEQ ID NO:5541); miR-449a (SEQ ID NO:5542); miR-449b (SEQ ID NO:5543); miR-449c (SEQ ID NO:5544); miR-449d (SEQ ID NO:5545); miR-450a-1 (SEQ ID NO:5546); miR-450a-2 (SEQ ID NO:5547); miR-450b (SEQ ID NO:5548); miR-451 (SEQ ID NO:5549); miR-452 (SEQ ID NO:5550); miR-453 (SEQ ID NO:5551); miR-454 (SEQ ID NO:5552); miR-455 (SEQ ID NO:5553); miR-483 (SEQ ID NO:5554); miR-484 (SEQ ID NO:5555); miR-485 (SEQ ID NO:5556); miR-486 (SEQ ID NO:5557); miR-487a (SEQ ID NO:5558); miR-487b (SEQ ID NO:5559); miR-488 (SEQ ID NO:5560); miR-489 (SEQ ID NO:5561); miR-490 (SEQ ID NO:5562); miR-491 (SEQ ID NO:5563); miR-493 (SEQ ID NO:5564); miR-494 (SEQ ID NO:5565); miR-495 (SEQ ID NO:5566); miR-496 (SEQ ID NO:5567); miR-497 (SEQ ID NO:5568); miR-499 (SEQ ID NO:5569); miR-500 (SEQ ID NO:5570); miR-502a-1 (SEQ ID NO:5571); miR-502a-2 (SEQ ID NO:5572); miR-502b (SEQ ID NO:5573); miR-503 (SEQ ID NO:5574); miR-504 (SEQ ID NO:5575); miR-505 (SEQ ID NO:5576); miR-532 (SEQ ID NO:5577); miR-539 (SEQ ID NO:5578); miR-541 (SEQ ID NO:5579); miR-542 (SEQ ID NO:5580); miR-543 (SEQ ID NO:5581); miR-544a (SEQ ID NO:5582); miR-544b-1 (SEQ ID NO:5583); miR-544b-2 (SEQ ID NO:5584); miR-545 (SEQ ID NO:5585); miR-551a (SEQ ID NO:5586); miR-551b (SEQ ID NO:5587); miR-562 (SEQ ID NO:5588); miR-568 (SEQ ID NO:5589); miR-574 (SEQ ID NO:5590); miR-582 (SEQ ID NO:5591); miR-584-1 (SEQ ID NO:5592); miR-584-2 (SEQ ID NO:5593); miR-584-3 (SEQ ID NO:5594); miR-584-4 (SEQ ID NO:5595); miR-584-5 (SEQ ID NO:5596); miR-584-6 (SEQ ID NO:5597); miR-584-7 (SEQ ID NO:5598); miR-584-8 (SEQ ID NO:5599); miR-592 (SEQ ID NO:5600); miR-599 (SEQ ID NO:5601); miR-615 (SEQ ID NO:5602); miR-628 (SEQ ID NO:5603); miR-631 (SEQ ID NO:5604); miR-652 (SEQ ID NO:5605); miR-653 (SEQ ID NO:5606); miR-654 (SEQ ID NO:5607); miR-655 (SEQ ID NO:5608); miR-656 (SEQ ID NO:5609); miR-658 (SEQ ID NO:5610); miR-660 (SEQ ID NO:5611); miR-664 (SEQ ID NO:5612); miR-664b (SEQ ID NO:5613); miR-665 (SEQ ID NO:5614); miR-669 (SEQ ID NO:5615); miR-670 (SEQ ID NO:5616); miR-671 (SEQ ID NO:5617); miR-677 (SEQ ID NO:5618); miR-708 (SEQ ID NO:5619); miR-744 (SEQ ID NO:5620); miR-758 (SEQ ID NO:5621); miR-759 (SEQ ID NO:5622); miR-760 (SEQ ID NO:5623); miR-761 (SEQ ID NO:5624); miR-763 (SEQ ID NO:5625); miR-764 (SEQ ID NO:5626); miR-767 (SEQ ID NO:5627); miR-769 (SEQ ID NO:5628); miR-873 (SEQ ID NO:5629); miR-874 (SEQ ID NO:5630); miR-875 (SEQ ID NO:5631); miR-876 (SEQ ID NO:5632); miR-877 (SEQ ID NO:5633); miR-885 (SEQ ID NO:5634); miR-935 (SEQ ID NO:5635); miR-940 (SEQ ID NO:5636); miR-1179 (SEQ ID NO:5637); miR-1185 (SEQ ID NO:5638); miR-1193 (SEQ ID NO:5639); miR-1197 (SEQ ID NO:5640); miR-1224 (SEQ ID NO:5641); miR-1225 (SEQ ID NO:5642); miR-1246 (SEQ ID NO:5643); miR-1247 (SEQ ID NO:5644); miR-1248-1 (SEQ ID NO:5645); miR-1248-2 (SEQ ID NO:5646); miR-1249 (SEQ ID NO:5647); miR-1251 (SEQ ID NO:5648); miR-1256 (SEQ ID NO:5649); miR-1260b (SEQ ID NO:5650); miR-1271 (SEQ ID NO:5651); miR-1277 (SEQ ID NO:5652); miR-1281 (SEQ ID NO:5653); miR-1282 (SEQ ID NO:5654); miR-1284 (SEQ ID NO:5655); miR-1287 (SEQ ID NO:5656); miR-1291 (SEQ ID NO:5657); miR-1296 (SEQ ID NO:5658); miR-1298 (SEQ ID NO:5659); miR-1301 (SEQ ID NO:5660); miR-1306 (SEQ ID NO:5661); miR-1307 (SEQ ID NO:5662); miR-1343 (SEQ ID NO:5663); miR-1388 (SEQ ID NO:5664); miR-1434 (SEQ ID NO:5665); miR-1468 (SEQ ID NO:5666); miR-1584 (SEQ ID NO:5667); miR-1603 (SEQ ID NO:5668); miR-1721 (SEQ ID NO:5669); miR-1777a (SEQ ID NO:5670); miR-1777b (SEQ ID NO:5671); miR-1814a (SEQ ID NO:5672); miR-1814b (SEQ ID NO:5673); miR-1814c (SEQ ID NO:5674); miR-1835 (SEQ ID NO:5675); miR-1839 (SEQ ID NO:5676); miR-1843 (SEQ ID NO:5677); miR-1940 (SEQ ID NO:5678); miR-2284a (SEQ ID NO:5679); miR-2284aa-1 (SEQ ID NO:5680); miR-2284aa-2 (SEQ ID NO:5681); miR-2284aa-3 (SEQ ID NO:5682); miR-2284aa-4 (SEQ ID NO:5683); miR-2284ab (SEQ ID NO:5684); miR-2284ac (SEQ ID NO:5685); miR-2284b (SEQ ID NO:5686); miR-2284c (SEQ ID NO:5687); miR-2284d (SEQ ID NO:5688); miR-2284e (SEQ ID NO:5689); miR-2284f (SEQ ID NO:5690); miR-2284g (SEQ ID NO:5691); miR-2284h (SEQ ID NO:5692); miR-2284i (SEQ ID NO:5693); miR-2284j (SEQ ID NO:5694); miR-2284k (SEQ ID NO:5695); miR-2284l (SEQ ID NO:5696); miR-2284m (SEQ ID NO:5697); miR-2284n (SEQ ID NO:5698); miR-2284o (SEQ ID NO:5699); miR-2284p (SEQ ID NO:5700); miR-2284q (SEQ ID NO:5701); miR-2284r (SEQ ID NO:5702); miR-2284s (SEQ ID NO:5703); miR-2284t (SEQ ID NO:5704); miR-2284u (SEQ ID NO:5705); miR-2284v (SEQ ID NO:5706); miR-2284w (SEQ ID NO:5707); miR-2284x (SEQ ID NO:5708); miR-2284y-1 (SEQ ID NO:5709); miR-2284y-2 (SEQ ID NO:5710); miR-2284y-3 (SEQ ID NO:5711); miR-2284y-4 (SEQ ID NO:5712); miR-2284y-5 (SEQ ID NO:5713); miR-2284y-6 (SEQ ID NO:5714); miR-2284y-7 (SEQ ID NO:5715); miR-2284z-1 (SEQ ID NO:5716); miR-2284z-2 (SEQ ID NO:5717); miR-2284z-3 (SEQ ID NO:5718); miR-2284z-4 (SEQ ID NO:5719); miR-2284z-5 (SEQ ID NO:5720); miR-2284z-6 (SEQ ID NO:5721); miR-2284z-7 (SEQ ID NO:5722); miR-2285a (SEQ ID NO:5723); miR-2285aa (SEQ ID NO:5724); miR-2285ab (SEQ ID NO:5725); miR-2285ac (SEQ ID NO:5726); miR-2285ad (SEQ ID NO:5727); miR-2285ae (SEQ ID NO:5728); miR-2285af-1 (SEQ ID NO:5729); miR-2285af-2 (SEQ ID NO:5730); miR-2285b-1 (SEQ ID NO:5731); miR-2285b-2 (SEQ ID NO:5732); miR-2285c (SEQ ID NO:5733); miR-2285d (SEQ ID NO:5734); miR-2285e-1 (SEQ ID NO:5735); miR-2285e-2 (SEQ ID NO:5736); miR-2285f-1 (SEQ ID NO:5737); miR-2285f-2 (SEQ ID NO:5738); miR-2285g-1 (SEQ ID NO:5739); miR-2285g-2 (SEQ ID NO:5740); miR-2285g-3 (SEQ ID NO:5741); miR-2285h (SEQ ID NO:5742); miR-2285i (SEQ ID NO:5743); miR-2285j-1 (SEQ ID NO:5744); miR-2285j-2 (SEQ ID NO:5745); miR-2285k-1 (SEQ ID NO:5746); miR-2285k-2 (SEQ ID NO:5747); miR-2285k-3 (SEQ ID NO:5748); miR-2285k-4 (SEQ ID NO:5749); miR-2285k-5 (SEQ ID NO:5750); miR-2285l (SEQ ID NO:5751); miR-2285m-1 (SEQ ID NO:5752); miR-2285m-2 (SEQ ID NO:5753); miR-2285m-3 (SEQ ID NO:5754); miR-2285m-4 (SEQ ID NO:5755); miR-2285m-5 (SEQ ID NO:5756); miR-2285n-1 (SEQ ID NO:5757); miR-2285n-2 (SEQ ID NO:5758); miR-2285n-3 (SEQ ID NO:5759); miR-2285n-4 (SEQ ID NO:5760); miR-2285n-5 (SEQ ID NO:5761); miR-2285n-6 (SEQ ID NO:5762); miR-2285n-7 (SEQ ID NO:5763); miR-2285o-1 (SEQ ID NO:5764); miR-2285o-2 (SEQ ID NO:5765); miR-2285o-3 (SEQ ID NO:5766); miR-2285o-4 (SEQ ID NO:5767); miR-2285o-5 (SEQ ID NO:5768); miR-2285p (SEQ ID NO:5769); miR-2285q (SEQ ID NO:5770); miR-2285r (SEQ ID NO:5771); miR-2285s (SEQ ID NO:5772); miR-2285t (SEQ ID NO:5773); miR-2285u (SEQ ID NO:5774); miR-2285v (SEQ ID NO:5775); miR-2285w (SEQ ID NO:5776); miR-2285x (SEQ ID NO:5777); miR-2285y (SEQ ID NO:5778); miR-2285z (SEQ ID NO:5779); miR-2286 (SEQ ID NO:5780); miR-2287 (SEQ ID NO:5781); miR-2288 (SEQ ID NO:5782); miR-2289 (SEQ ID NO:5783); miR-2290 (SEQ ID NO:5784); miR-2291 (SEQ ID NO:5785); miR-2292 (SEQ ID NO:5786); miR-2293 (SEQ ID NO:5787); miR-2294 (SEQ ID NO:5788); miR-2295 (SEQ ID NO:5789); miR-2296 (SEQ ID NO:5790); miR-2297 (SEQ ID NO:5791); miR-2298 (SEQ ID NO:5792); miR-2299 (SEQ ID NO:5793); miR-2300a (SEQ ID NO:5794); miR-2300b (SEQ ID NO:5795); miR-2301 (SEQ ID NO:5796); miR-2302 (SEQ ID NO:5797); miR-2303 (SEQ ID NO:5798); miR-2304 (SEQ ID NO:5799); miR-2305 (SEQ ID NO:5800); miR-2306 (SEQ ID NO:5801); miR-2307 (SEQ ID NO:5802); miR-2308 (SEQ ID NO:5803); miR-2309 (SEQ ID NO:5804); miR-2310 (SEQ ID NO:5805); miR-2311 (SEQ ID NO:5806); miR-2312 (SEQ ID NO:5807); miR-2313 (SEQ ID NO:5808); miR-2314 (SEQ ID NO:5809); miR-2315 (SEQ ID NO:5810); miR-2316 (SEQ ID NO:5811); miR-2317 (SEQ ID NO:5812); miR-2318 (SEQ ID NO:5813); miR-2319a (SEQ ID NO:5814); miR-2319b (SEQ ID NO:5815); miR-2320 (SEQ ID NO:5816); miR-2321 (SEQ ID NO:5817); miR-2322 (SEQ ID NO:5818); miR-2323 (SEQ ID NO:5819); miR-2324 (SEQ ID NO:5820); miR-2325a (SEQ ID NO:5821); miR-2325b (SEQ ID NO:5822); miR-2325c (SEQ ID NO:5823); miR-2326 (SEQ ID NO:5824); miR-2327 (SEQ ID NO:5825); miR-2328 (SEQ ID NO:5826); miR-2329-1 (SEQ ID NO:5827); miR-2329-2 (SEQ ID NO:5828); miR-2330 (SEQ ID NO:5829); miR-2331 (SEQ ID NO:5830); miR-2332 (SEQ ID NO:5831); miR-2333 (SEQ ID NO:5832); miR-2334 (SEQ ID NO:5833); miR-2335 (SEQ ID NO:5834); miR-2336 (SEQ ID NO:5835); miR-2337 (SEQ ID NO:5836); miR-2338 (SEQ ID NO:5837); miR-2339 (SEQ ID NO:5838); miR-2340 (SEQ ID NO:5839); miR-2341 (SEQ ID NO:5840); miR-2342 (SEQ ID NO:5841); miR-2343 (SEQ ID NO:5842); miR-2344 (SEQ ID NO:5843); miR-2345 (SEQ ID NO:5844); miR-2346 (SEQ ID NO:5845); miR-2347 (SEQ ID NO:5846); miR-2348 (SEQ ID NO:5847); miR-2349 (SEQ ID NO:5848); miR-2350 (SEQ ID NO:5849); miR-2351 (SEQ ID NO:5850); miR-2352 (SEQ ID NO:5851); miR-2353 (SEQ ID NO:5852); miR-2354 (SEQ ID NO:5853); miR-2355 (SEQ ID NO:5854); miR-2356 (SEQ ID NO:5855); miR-2357 (SEQ ID NO:5856); miR-2358 (SEQ ID NO:5857); miR-2359 (SEQ ID NO:5858); miR-2360 (SEQ ID NO:5859); miR-2361 (SEQ ID NO:5860); miR-2362 (SEQ ID NO:5861); miR-2363-1 (SEQ ID NO:5862); miR-2363-2 (SEQ ID NO:5863); miR-2364 (SEQ ID NO:5864); miR-2365 (SEQ ID NO:5865); miR-2366 (SEQ ID NO:5866); miR-2367 (SEQ ID NO:5867); miR-2368 (SEQ ID NO:5868); miR-2369 (SEQ ID NO:5869); miR-2370 (SEQ ID NO:5870); miR-2371 (SEQ ID NO:5871); miR-2372 (SEQ ID NO:5872); miR-2373 (SEQ ID NO:5873); miR-2374 (SEQ ID NO:5874); miR-2375 (SEQ ID NO:5875); miR-2376 (SEQ ID NO:5876); miR-2377 (SEQ ID NO:5877); miR-2378 (SEQ ID NO:5878); miR-2379 (SEQ ID NO:5879); miR-2380 (SEQ ID NO:5880); miR-2381 (SEQ ID NO:5881); miR-2382 (SEQ ID NO:5882); miR-2383 (SEQ ID NO:5883); miR-2384 (SEQ ID NO:5884); miR-2385 (SEQ ID NO:5885); miR-2386 (SEQ ID NO:5886); miR-2387 (SEQ ID NO:5887); miR-2388 (SEQ ID NO:5888); miR-2389 (SEQ ID NO:5889); miR-2390 (SEQ ID NO:5890); miR-2392 (SEQ ID NO:5891); miR-2393 (SEQ ID NO:5892); miR-2394 (SEQ ID NO:5893); miR-2395 (SEQ ID NO:5894); miR-2396 (SEQ ID NO:5895); miR-2397 (SEQ ID NO:5896); miR-2398 (SEQ ID NO:5897); miR-2399 (SEQ ID NO:5898); miR-2400 (SEQ ID NO:5899); miR-2401 (SEQ ID NO:5900); miR-2402 (SEQ ID NO:5901); miR-2403 (SEQ ID NO:5902); miR-2404-1 (SEQ ID NO:5903); miR-2404-2 (SEQ ID NO:5904); miR-2405 (SEQ ID NO:5905); miR-2406 (SEQ ID NO:5906); miR-2407 (SEQ ID NO:5907); miR-2408 (SEQ ID NO:5908); miR-2409 (SEQ ID NO:5909); miR-2410 (SEQ ID NO:5910); miR-2411 (SEQ ID NO:5911); miR-2412 (SEQ ID NO:5912); miR-2413 (SEQ ID NO:5913); miR-2414 (SEQ ID NO:5914); miR-2415 (SEQ ID NO:5915); miR-2416 (SEQ ID NO:5916); miR-2417 (SEQ ID NO:5917); miR-2418 (SEQ ID NO:5918); miR-2419 (SEQ ID NO:5919); miR-2420 (SEQ ID NO:5920); miR-2421 (SEQ ID NO:5921); miR-2422 (SEQ ID NO:5922); miR-2423 (SEQ ID NO:5923); miR-2424 (SEQ ID NO:5924); miR-2425 (SEQ ID NO:5925); miR-2426 (SEQ ID NO:5926); miR-2427 (SEQ ID NO:5927); miR-2428 (SEQ ID NO:5928); miR-2429 (SEQ ID NO:5929); miR-2430 (SEQ ID NO:5930); miR-2431 (SEQ ID NO:5931); miR-2432 (SEQ ID NO:5932); miR-2433 (SEQ ID NO:5933); miR-2434 (SEQ ID NO:5934); miR-2435 (SEQ ID NO:5935); miR-2436 (SEQ ID NO:5936); miR-2437 (SEQ ID NO:5937); miR-2438 (SEQ ID NO:5938); miR-2439 (SEQ ID NO:5939); miR-2440 (SEQ ID NO:5940); miR-2441 (SEQ ID NO:5941); miR-2442 (SEQ ID NO:5942); miR-2443 (SEQ ID NO:5943); miR-2444 (SEQ ID NO:5944); miR-2446 (SEQ ID NO:5945); miR-2447 (SEQ ID NO:5946); miR-2448 (SEQ ID NO:5947); miR-2449 (SEQ ID NO:5948); miR-2450a (SEQ ID NO:5949); miR-2450b (SEQ ID NO:5950); miR-2450c (SEQ ID NO:5951); miR-2451 (SEQ ID NO:5952); miR-2452 (SEQ ID NO:5953); miR-2453 (SEQ ID NO:5954); miR-2454 (SEQ ID NO:5955); miR-2455 (SEQ ID NO:5956); miR-2456 (SEQ ID NO:5957); miR-2457 (SEQ ID NO:5958); miR-2458 (SEQ ID NO:5959); miR-2459 (SEQ ID NO:5960); miR-2460 (SEQ ID NO:5961); miR-2461 (SEQ ID NO:5962); miR-2462 (SEQ ID NO:5963); miR-2463 (SEQ ID NO:5964); miR-2464 (SEQ ID NO:5965); miR-2465 (SEQ ID NO:5966); miR-2466 (SEQ ID NO:5967); miR-2467 (SEQ ID NO:5968); miR-2468 (SEQ ID NO:5969); miR-2469 (SEQ ID NO:5970); miR-2470 (SEQ ID NO:5971); miR-2471 (SEQ ID NO:5972); miR-2472 (SEQ ID NO:5973); miR-2473 (SEQ ID NO:5974); miR-2474 (SEQ ID NO:5975); miR-2475 (SEQ ID NO:5976); miR-2477 (SEQ ID NO:5977); miR-2478 (SEQ ID NO:5978); miR-2479 (SEQ ID NO:5979); miR-2480 (SEQ ID NO:5980); miR-2481 (SEQ ID NO:5981); miR-2482 (SEQ ID NO:5982); miR-2483 (SEQ ID NO:5983); miR-2484 (SEQ ID NO:5984); miR-2485 (SEQ ID NO:5985); miR-2486 (SEQ ID NO:5986); miR-2487 (SEQ ID NO:5987); miR-2488 (SEQ ID NO:5988); miR-2489 (SEQ ID NO:5989); miR-2881 (SEQ ID NO:5990); miR-2882 (SEQ ID NO:5991); miR-2883 (SEQ ID NO:5992); miR-2885 (SEQ ID NO:5993); miR-2886 (SEQ ID NO:5994); miR-2887-1 (SEQ ID NO:5995); miR-2887-2 (SEQ ID NO:5996); miR-2888-1 (SEQ ID NO:5997); miR-2888-2 (SEQ ID NO:5998); miR-2889 (SEQ ID NO:5999); miR-2890 (SEQ ID NO:6000); miR-2891 (SEQ ID NO:6001); miR-2892 (SEQ ID NO:6002); miR-2893 (SEQ ID NO:6003); miR-2894 (SEQ ID NO:6004); miR-2895 (SEQ ID NO:6005); miR-2896 (SEQ ID NO:6006); miR-2897 (SEQ ID NO:6007); miR-2898 (SEQ ID NO:6008); miR-2899 (SEQ ID NO:6009); miR-2900 (SEQ ID NO:6010); miR-2901 (SEQ ID NO:6011); miR-2902 (SEQ ID NO:6012); miR-2903 (SEQ ID NO:6013); miR-2904-1 (SEQ ID NO:6014); miR-2904-2 (SEQ ID NO:6015); miR-2904-3 (SEQ ID NO:6016); miR-2917 (SEQ ID NO:6017); miR-2957 (SEQ ID NO:6018); miR-3120 (SEQ ID NO:6019); miR-3141 (SEQ ID NO:6020); miR-3154 (SEQ ID NO:6021); miR-3431 (SEQ ID NO:6022); miR-3432-1 (SEQ ID NO:6023); miR-3432-2 (SEQ ID NO:6024); miR-3578 (SEQ ID NO:6025); miR-3596 (SEQ ID NO:6026); miR-3600 (SEQ ID NO:6027); miR-3601 (SEQ ID NO:6028); miR-3602 (SEQ ID NO:6029); miR-3604-1 (SEQ ID NO:6030); miR-3604-2 (SEQ ID NO:6031); miR-3613 (SEQ ID NO:6032); miR-3613b (SEQ ID NO:6033); miR-3660 (SEQ ID NO:6034); miR-3956 (SEQ ID NO:6035); miR-3957 (SEQ ID NO:6036); miR-4286-1 (SEQ ID NO:6037); miR-4286-2 (SEQ ID NO:6038); miR-6119 (SEQ ID NO:6039); miR-6120 (SEQ ID NO:6040); miR-6121 (SEQ ID NO:6041); miR-6122 (SEQ ID NO:6042); miR-6123 (SEQ ID NO:6043); miR-6516 (SEQ ID NO:6044); miR-6517 (SEQ ID NO:6045); miR-6518 (SEQ ID NO:6046); miR-6519 (SEQ ID NO:6047); miR-6520 (SEQ ID NO:6048); miR-6521 (SEQ ID NO:6049); miR-6522 (SEQ ID NO:6050); miR-6523 (SEQ ID NO:6051); miR-6523b (SEQ ID NO:6052); miR-6524 (SEQ ID NO:6053); miR-6525 (SEQ ID NO:6054); miR-6526-1 (SEQ ID NO:6055); miR-6526-2 (SEQ ID NO:6056); miR-6526-3 (SEQ ID NO:6057); miR-6527 (SEQ ID NO:6058); miR-6528 (SEQ ID NO:6059); miR-6529 (SEQ ID NO:6060); miR-6529b (SEQ ID NO:6061); miR-6530 (SEQ ID NO:6062); miR-6531 (SEQ ID NO:6063); miR-6532 (SEQ ID NO:6064); miR-6533 (SEQ ID NO:6065); miR-6534 (SEQ ID NO:6066); miR-6535 (SEQ ID NO:6067); miR-6536-1 (SEQ ID NO:6068); miR-6536-2 (SEQ ID NO:6069); miR-7691 (SEQ ID NO:6070); miR-7857 (SEQ ID NO:6071); miR-7858 (SEQ ID NO:6072); miR-7859 (SEQ ID NO:6073); miR-7860 (SEQ ID NO:6074); miR-7861 (SEQ ID NO:6075); miR-7862 (SEQ ID NO:6076); miR-7863 (SEQ ID NO:6077); miR-7864 (SEQ ID NO:6078); and miR-7865 (SEQ ID NO:6079).

The following sheep miRNAs could be used: let-7a (SEQ ID NO:6080); let-7b (SEQ ID NO:6081); let-7c (SEQ ID NO:6082); let-7d (SEQ ID NO:6083); let-7f (SEQ ID NO:6084); let-7g (SEQ ID NO:6085); let-7i (SEQ ID NO:6086); miR-10a (SEQ ID NO:6087); miR-10b (SEQ ID NO:6088); miR-16b (SEQ ID NO:6089); miR-17 (SEQ ID NO:6090); miR-19b (SEQ ID NO:6091); miR-21 (SEQ ID NO:6092); miR-22 (SEQ ID NO:6093); miR-23a (SEQ ID NO:6094); miR-23b (SEQ ID NO:6095); miR-25 (SEQ ID NO:6096); miR-26a (SEQ ID NO:6097); miR-26b (SEQ ID NO:6098); miR-27a (SEQ ID NO:6099); miR-29a (SEQ ID NO:6100); miR-29b (SEQ ID NO:6101); miR-30a (SEQ ID NO:6102); miR-30b (SEQ ID NO:6103); miR-30c (SEQ ID NO:6104); miR-30d (SEQ ID NO:6105); miR-99a (SEQ ID NO:6106); miR-103 (SEQ ID NO:6107); miR-106a (SEQ ID NO:6108); miR-106b (SEQ ID NO:6109); miR-107 (SEQ ID NO:6110); miR-125b (SEQ ID NO:6111); miR-127 (SEQ ID NO:6112); miR-133 (SEQ ID NO:6113); miR-134 (SEQ ID NO:6114); miR-136 (SEQ ID NO:6115); miR-143 (SEQ ID NO:6116); miR-148a (SEQ ID NO:6117); miR-150 (SEQ ID NO:6118); miR-152 (SEQ ID NO:6119); miR-154a (SEQ ID NO:6120); miR-154b (SEQ ID NO:6121); miR-181a-1 (SEQ ID NO:6122); miR-181a-2 (SEQ ID NO:6123); miR-191 (SEQ ID NO:6124); miR-194 (SEQ ID NO:6125); miR-199a (SEQ ID NO:6126); miR-200a (SEQ ID NO:6127); miR-200b (SEQ ID NO:6128); miR-200c (SEQ ID NO:6129); miR-218a (SEQ ID NO:6130); miR-221 (SEQ ID NO:6131); miR-299 (SEQ ID NO:6132); miR-323a (SEQ ID NO:6133); miR-323b (SEQ ID NO:6134); miR-323c (SEQ ID NO:6135); miR-329a (SEQ ID NO:6136); miR-329b (SEQ ID NO:6137); miR-362 (SEQ ID NO:6138); miR-369 (SEQ ID NO:6139); miR-370 (SEQ ID NO:6140); miR-374a (SEQ ID NO:6141); miR-374b (SEQ ID NO:6142); miR-376a (SEQ ID NO:6143); miR-376b (SEQ ID NO:6144); miR-376c (SEQ ID NO:6145); miR-376d (SEQ ID NO:6146); miR-376e (SEQ ID NO:6147); miR-377 (SEQ ID NO:6148); miR-379 (SEQ ID NO:6149); miR-380 (SEQ ID NO:6150); miR-381 (SEQ ID NO:6151); miR-382 (SEQ ID NO:6152); miR-409 (SEQ ID NO:6153); miR-410 (SEQ ID NO:6154); miR-411a (SEQ ID NO:6155); miR-411b (SEQ ID NO:6156); miR-412 (SEQ ID NO:6157); miR-431 (SEQ ID NO:6158); miR-432 (SEQ ID NO:6159); miR-433 (SEQ ID NO:6160); miR-485 (SEQ ID NO:6161); miR-487a (SEQ ID NO:6162); miR-487b (SEQ ID NO:6163); miR-493 (SEQ ID NO:6164); miR-494 (SEQ ID NO:6165); miR-495 (SEQ ID NO:6166); miR-496 (SEQ ID NO:6167); miR-539 (SEQ ID NO:6168); miR-541 (SEQ ID NO:6169); miR-543 (SEQ ID NO:6170); miR-544 (SEQ ID NO:6171); miR-654 (SEQ ID NO:6172); miR-655 (SEQ ID NO:6173); miR-665 (SEQ ID NO:6174); miR-668 (SEQ ID NO:6175); miR-758 (SEQ ID NO:6176); miR-1185 (SEQ ID NO:6177); miR-1193 (SEQ ID NO:6178); miR-1197 (SEQ ID NO:6179); miR-3955 (SEQ ID NO:6180); miR-3956 (SEQ ID NO:6181); miR-3957 (SEQ ID NO:6182); miR-3958 (SEQ ID NO:6183); and miR-3959 (SEQ ID NO:6184).

The following pig miRNAs could be used: let-7a-1 (SEQ ID NO:6185); let-7a-2 (SEQ ID NO:6186); let-7c (SEQ ID NO:6187); let-7d (SEQ ID NO:6188); let-7e (SEQ ID NO:6189); let-7f-1 (SEQ ID NO:6190); let-7f-2 (SEQ ID NO:6191); let-7g (SEQ ID NO:6192); let-7i (SEQ ID NO:6193); miR-1 (SEQ ID NO:6194); miR-7-1 (SEQ ID NO:6195); miR-7-2 (SEQ ID NO:6196); miR-9-1 (SEQ ID NO:6197); miR-9-2 (SEQ ID NO:6198); miR-9-3 (SEQ ID NO:6199); miR-10a (SEQ ID NO:6200); miR-10b (SEQ ID NO:6201); miR-15a (SEQ ID NO:6202); miR-15b (SEQ ID NO:6203); miR-16-1 (SEQ ID NO:6204); miR-16-2 (SEQ ID NO:6205); miR-17 (SEQ ID NO:6206); miR-18a (SEQ ID NO:6207); miR-18b (SEQ ID NO:6208); miR-19a (SEQ ID NO:6209); miR-19b-1 (SEQ ID NO:6210); miR-19b-2 (SEQ ID NO:6211); miR-20a (SEQ ID NO:6212); miR-20b-1 (SEQ ID NO:6213); miR-20b-2 (SEQ ID NO:6214); miR-21 (SEQ ID NO:6215); miR-22 (SEQ ID NO:6216); miR-23a (SEQ ID NO:6217); miR-23b (SEQ ID NO:6218); miR-24-1 (SEQ ID NO:6219); miR-24-2 (SEQ ID NO:6220); miR-26a (SEQ ID NO:6221); miR-27a (SEQ ID NO:6222); miR-27b (SEQ ID NO:6223); miR-28 (SEQ ID NO:6224); miR-29a (SEQ ID NO:6225); miR-29b-1 (SEQ ID NO:6226); miR-29b-2 (SEQ ID NO:6227); miR-29c (SEQ ID NO:6228); miR-30a (SEQ ID NO:6229); miR-30b (SEQ ID NO:6230); miR-30c-1 (SEQ ID NO:6231); miR- 30c-2 (SEQ ID NO:6232); miR-30d (SEQ ID NO:6233); miR-30e (SEQ ID NO:6234); miR-31 (SEQ ID NO:6235); miR-32 (SEQ ID NO:6236); miR-34a (SEQ ID NO:6237); miR-34c-1 (SEQ ID NO:6238); miR-34c-2 (SEQ ID NO:6239); miR-92a-1 (SEQ ID NO:6240); miR-92a-2 (SEQ ID NO:6241); miR-92b (SEQ ID NO:6242); miR-95 (SEQ ID NO:6243); miR-98 (SEQ ID NO:6244); miR-99a (SEQ ID NO:6245); miR-99b (SEQ ID NO:6246); miR-100 (SEQ ID NO:6247); miR-101-1 (SEQ ID NO:6248); miR-101-2 (SEQ ID NO:6249); miR-103-1 (SEQ ID NO:6250); miR-103-2 (SEQ ID NO:6251); miR-105-1 (SEQ ID NO:6252); miR-105-2 (SEQ ID NO:6253); miR-106a (SEQ ID NO:6254); miR-107 (SEQ ID NO:6255); miR-122 (SEQ ID NO:6256); miR-124a-1 (SEQ ID NO:6257); miR-124a-2 (SEQ ID NO:6258); miR-125a (SEQ ID NO:6259); miR-125b-1 (SEQ ID NO:6260); miR-125b-2 (SEQ ID NO:6261); miR-126 (SEQ ID NO:6262); miR-127 (SEQ ID NO:6263); miR-128-1 (SEQ ID NO:6264); miR-128-2 (SEQ ID NO:6265); miR-129a (SEQ ID NO:6266); miR-129b (SEQ ID NO:6267); miR-130a (SEQ ID NO:6268); miR-130b (SEQ ID NO:6269); miR-132 (SEQ ID NO:6270); miR-133a-1 (SEQ ID NO:6271); miR-133a-2 (SEQ ID NO:6272); miR-133b (SEQ ID NO:6273); miR-135-1 (SEQ ID NO:6274); miR-135-2 (SEQ ID NO:6275); miR-136 (SEQ ID NO:6276); miR-137 (SEQ ID NO:6277); miR-138 (SEQ ID NO:6278); miR-139 (SEQ ID NO:6279); miR-140 (SEQ ID NO:6280); miR-142 (SEQ ID NO:6281); miR-143 (SEQ ID NO:6282); miR-144 (SEQ ID NO:6283); miR-145 (SEQ ID NO:6284); miR-146a (SEQ ID NO:6285); miR-146b (SEQ ID NO:6286); miR-148a (SEQ ID NO:6287); miR-148b (SEQ ID NO:6288); miR-149 (SEQ ID NO:6289); miR-150-1 (SEQ ID NO:6290); miR-150-2 (SEQ ID NO:6291); miR-151 (SEQ ID NO:6292); miR-152 (SEQ ID NO:6293); miR-153 (SEQ ID NO:6294); miR-155 (SEQ ID NO:6295); miR-181a-1 (SEQ ID NO:6296); miR-181a-2 (SEQ ID NO:6297); miR-181b-1 (SEQ ID NO:6298); miR-181b-2 (SEQ ID NO:6299); miR-181c (SEQ ID NO:6300); miR-181d (SEQ ID NO:6301); miR-182 (SEQ ID NO:6302); miR-183 (SEQ ID NO:6303); miR-184 (SEQ ID NO:6304); miR-185 (SEQ ID NO:6305); miR-186 (SEQ ID NO:6306); miR-187 (SEQ ID NO:6307); miR-190a (SEQ ID NO:6308); miR-190b (SEQ ID NO:6309); miR-191 (SEQ ID NO:6310); miR-192 (SEQ ID NO:6311); miR-193a (SEQ ID NO:6312); miR-194a (SEQ ID NO:6313); miR-194b (SEQ ID NO:6314); miR-195 (SEQ ID NO:6315); miR-196a-1 (SEQ ID NO:6316); miR-196a-2 (SEQ ID NO:6317); miR-196b-1 (SEQ ID NO:6318); miR-196b-2 (SEQ ID NO:6319); miR-199a-1 (SEQ ID NO:6320); miR-199a-2 (SEQ ID NO:6321); miR-199b (SEQ ID NO:6322); miR-202 (SEQ ID NO:6323); miR-204 (SEQ ID NO:6324); miR-205 (SEQ ID NO:6325); miR-206 (SEQ ID NO:6326); miR-208b (SEQ ID NO:6327); miR-210 (SEQ ID NO:6328); miR-212 (SEQ ID NO:6329); miR-214 (SEQ ID NO:6330); miR-215 (SEQ ID NO:6331); miR-216-1 (SEQ ID NO:6332); miR-216-2 (SEQ ID NO:6333); miR-217-1 (SEQ ID NO:6334); miR-217-2 (SEQ ID NO:6335); miR-218-1 (SEQ ID NO:6336); miR-218-2 (SEQ ID NO:6337); miR-218b (SEQ ID NO:6338); miR-219 (SEQ ID NO:6339); miR-221 (SEQ ID NO:6340); miR-222 (SEQ ID NO:6341); miR-224 (SEQ ID NO:6342); miR-296 (SEQ ID NO:6343); miR-299 (SEQ ID NO:6344); miR-301 (SEQ ID NO:6345); miR-320 (SEQ ID NO:6346); miR-323 (SEQ ID NO:6347); miR-324 (SEQ ID NO:6348); miR-325 (SEQ ID NO:6349); miR-326 (SEQ ID NO:6350); miR-328 (SEQ ID NO:6351); miR-331 (SEQ ID NO:6352); miR-335 (SEQ ID NO:6353); miR-338 (SEQ ID NO:6354); miR-339-1 (SEQ ID NO:6355); miR-339-2 (SEQ ID NO:6356); miR-340-1 (SEQ ID NO:6357); miR-340-2 (SEQ ID NO:6358); miR-342 (SEQ ID NO:6359); miR-345-1 (SEQ ID NO:6360); miR-345-2 (SEQ ID NO:6361); miR-361 (SEQ ID NO:6362); miR-362 (SEQ ID NO:6363); miR-363-1 (SEQ ID NO:6364); miR-363-2 (SEQ ID NO:6365); miR-365-1 (SEQ ID NO:6366); miR-365-2 (SEQ ID NO:6367); miR-369 (SEQ ID NO:6368); miR-370 (SEQ ID NO:6369); miR-374a (SEQ ID NO:6370); miR-374b (SEQ ID NO:6371); miR-376a (SEQ ID NO:6372); miR-376b (SEQ ID NO:6373); miR-376c (SEQ ID NO:6374); miR-378-1 (SEQ ID NO:6375); miR-378-2 (SEQ ID NO:6376); miR-381 (SEQ ID NO:6377); miR-382 (SEQ ID NO:6378); miR-383 (SEQ ID NO:6379); miR-411 (SEQ ID NO:6380); miR-421 (SEQ ID NO:6381); miR-423 (SEQ ID NO:6382); miR-424 (SEQ ID NO:6383); miR-425 (SEQ ID NO:6384); miR-429 (SEQ ID NO:6385); miR-432 (SEQ ID NO:6386); miR-450a (SEQ ID NO:6387); miR-450b (SEQ ID NO:6388); miR-450c (SEQ ID NO:6389); miR-451 (SEQ ID NO:6390); miR-452 (SEQ ID NO:6391); miR-455 (SEQ ID NO:6392); miR-484 (SEQ ID NO:6393); miR-486-1 (SEQ ID NO:6394); miR-486-2 (SEQ ID NO:6395); miR-487b (SEQ ID NO:6396); miR-489 (SEQ ID NO:6397); miR-490-1 (SEQ ID NO:6398); miR-490-2 (SEQ ID NO:6399); miR-491 (SEQ ID NO:6400); miR-493 (SEQ ID NO:6401); miR-494 (SEQ ID NO:6402); miR-497 (SEQ ID NO:6403); miR-499 (SEQ ID NO:6404); miR-500 (SEQ ID NO:6405); miR-503 (SEQ ID NO:6406); miR-504 (SEQ ID NO:6407); miR-505 (SEQ ID NO:6408); miR-532 (SEQ ID NO:6409); miR-542 (SEQ ID NO:6410); miR-545 (SEQ ID NO:6411); miR-551a (SEQ ID NO:6412); miR-574 (SEQ ID NO:6413); miR-582 (SEQ ID NO:6414); miR-615 (SEQ ID NO:6415); miR-628 (SEQ ID NO:6416); miR-652 (SEQ ID NO:6417); miR-664 (SEQ ID NO:6418); miR-671 (SEQ ID NO:6419); miR-676-1 (SEQ ID NO:6420); miR-676-2 (SEQ ID NO:6421); miR-708 (SEQ ID NO:6422); miR-744 (SEQ ID NO:6423); miR-758 (SEQ ID NO:6424); miR-769 (SEQ ID NO:6425); miR-874 (SEQ ID NO:6426); miR-885 (SEQ ID NO:6427); miR-935 (SEQ ID NO:6428); miR-1224 (SEQ ID NO:6429); miR-1249-1 (SEQ ID NO:6430); miR-1249-2 (SEQ ID NO:6431); miR-1271 (SEQ ID NO:6432); miR-1277 (SEQ ID NO:6433); miR-1285 (SEQ ID NO:6434); miR-1296 (SEQ ID NO:6435); miR-1306 (SEQ ID NO:6436); miR-1307 (SEQ ID NO:6437); miR-1343 (SEQ ID NO:6438); miR-1468 (SEQ ID NO:6439); miR-1839 (SEQ ID NO:6440); miR-2320 (SEQ ID NO:6441); miR-2366-1 (SEQ ID NO:6442); miR-2366-2 (SEQ ID NO:6443); miR-2411 (SEQ ID NO:6444); miR-2483 (SEQ ID NO:6445); miR-3613 (SEQ ID NO:6446); miR-4331 (SEQ ID NO:6447); miR-4332 (SEQ ID NO:6448); miR-4334 (SEQ ID NO:6449); miR-4335 (SEQ ID NO:6450); miR-4337 (SEQ ID NO:6451); miR-4338 (SEQ ID NO:6452); miR-4339 (SEQ ID NO:6453); miR-7134 (SEQ ID NO:6454); miR-7135 (SEQ ID NO:6455); miR-7136 (SEQ ID NO:6456); miR-7137 (SEQ ID NO:6457); miR-7138 (SEQ ID NO:6458); miR-7139 (SEQ ID NO:6459); miR-7140 (SEQ ID NO:6460); miR-7141 (SEQ ID NO:6461); miR-7142 (SEQ ID NO:6462); miR-7143 (SEQ ID NO:6463); and miR-7144 (SEQ ID NO:6464).

The following rice miRNAs can be used: MIR156a (SEQ ID NO:6465); MIR156b (SEQ ID NO:6466); MIR156c (SEQ ID NO:6467); MIR156d (SEQ ID NO:6468); MIR156e (SEQ ID NO:6469); MIR156f (SEQ ID NO:6470); MIR156g (SEQ ID NO:6471); MIR156h (SEQ ID NO:6472); MIR156i (SEQ ID NO:6473); MIR156j (SEQ ID NO:6474); MIR156k (SEQ ID NO:6475); MIR156l (SEQ ID NO:6476); MIR159a (SEQ ID NO:6477); MIR159b (SEQ ID NO:6478); MIR159c (SEQ ID NO:6479); MIR159d (SEQ ID NO:6480); MIR159e (SEQ ID NO:6481); MIR159f (SEQ ID NO:6482); MIR160a (SEQ ID NO:6483); MIR160b (SEQ ID NO:6484); MIR160c (SEQ ID NO:6485); MIR160d (SEQ ID NO:6486); MIR160e (SEQ ID NO:6487); MIR160f (SEQ ID NO:6488); MIR162a (SEQ ID NO:6489); MIR162b (SEQ ID NO:6490); MIR164a (SEQ ID NO:6491); MIR164b (SEQ ID NO:6492); MIR164c (SEQ ID NO:6493); MIR164d (SEQ ID NO:6494); MIR164e (SEQ ID NO:6495); MIR164f (SEQ ID NO:6496); MIR166a (SEQ ID NO:6497); MIR166b (SEQ ID NO:6498); MIR166c (SEQ ID NO:6499); MIR166d (SEQ ID NO:6500); MIR166e (SEQ ID NO:6501); MIR166f (SEQ ID NO:6502); MIR166g (SEQ ID NO:6503); MIR166h (SEQ ID NO:6504); MIR166i (SEQ ID NO:6505); MIR166j (SEQ ID NO:6506); MIR166k (SEQ ID NO:6507); MIR166l (SEQ ID NO:6508); MIR166m (SEQ ID NO:6509); MIR167a (SEQ ID NO:6510); MIR167b (SEQ ID NO:6511); MIR167c (SEQ ID NO:6512); MIR167d (SEQ ID NO:6513); MIR167e (SEQ ID NO:6514); MIR167f (SEQ ID NO:6515); MIR167g (SEQ ID NO:6516); MIR167h (SEQ ID NO:6517); MIR167i (SEQ ID NO:6518); MIR167j (SEQ ID NO:6519); MIR168a (SEQ ID NO:6520); MIR168b (SEQ ID NO:6521); MIR169a (SEQ ID NO:6522); MIR169b (SEQ ID NO:6523); MIR169c (SEQ ID NO:6524); MIR169d (SEQ ID NO:6525); MIR169e (SEQ ID NO:6526); MIR169f (SEQ ID NO:6527); MIR169g (SEQ ID NO:6528); MIR169h (SEQ ID NO:6529); MIR169i (SEQ ID NO:6530); MIR169j (SEQ ID NO:6531); MIR169k (SEQ ID NO:6532); MIR169l (SEQ ID NO:6533); MIR169m (SEQ ID NO:6534); MIR169n (SEQ ID NO:6535); MIR169o (SEQ ID NO:6536); MIR169p (SEQ ID NO:6537); MIR169q (SEQ ID NO:6538); MIR169r (SEQ ID NO:6539); MIR171a (SEQ ID NO:6540); MIR171b (SEQ ID NO:6541); MIR171c (SEQ ID NO:6542); MIR171d (SEQ ID NO:6543); MIR171e (SEQ ID NO:6544); MIR171f (SEQ ID NO:6545); MIR171g (SEQ ID NO:6546); MIR171h (SEQ ID NO:6547); MIR171i (SEQ ID NO:6548); MIR172a (SEQ ID NO:6549); MIR172b (SEQ ID NO:6550); MIR172c (SEQ ID NO:6551); MIR172d (SEQ ID NO:6552); MIR319a (SEQ ID NO:6553); MIR319b (SEQ ID NO:6554); MIR390 (SEQ ID NO:6555); MIR393a (SEQ ID NO:6556); MIR393b (SEQ ID NO:6557); MIR394 (SEQ ID NO:6558); MIR395a (SEQ ID NO:6559); MIR395b (SEQ ID NO:6560); MIR395c (SEQ ID NO:6561); MIR395d (SEQ ID NO:6562); MIR395e (SEQ ID NO:6563); MIR395f (SEQ ID NO:6564); MIR395g (SEQ ID NO:6565); MIR395h (SEQ ID NO:6566); MIR395i (SEQ ID NO:6567); MIR395j (SEQ ID NO:6568); MIR395k (SEQ ID NO:6569); MIR395l (SEQ ID NO:6570); MIR395m (SEQ ID NO:6571); MIR395n (SEQ ID NO:6572); MIR395o (SEQ ID NO:6573); MIR395p (SEQ ID NO:6574); MIR395q (SEQ ID NO:6575); MIR395r (SEQ ID NO:6576); MIR395s (SEQ ID NO:6577); MIR395t (SEQ ID NO:6578); MIR395u (SEQ ID NO:6579); MIR395v (SEQ ID NO:6580); MIR395w (SEQ ID NO:6581); MIR395x (SEQ ID NO:6582); MIR395y (SEQ ID NO:6583); MIR396a (SEQ ID NO:6584); MIR396b (SEQ ID NO:6585); MIR396c (SEQ ID NO:6586); MIR396d (SEQ ID NO:6587); MIR396e (SEQ ID NO:6588); MIR396f (SEQ ID NO:6589); MIR396g (SEQ ID NO:6590); MIR396h (SEQ ID NO:6591); MIR397a (SEQ ID NO:6592); MIR397b (SEQ ID NO:6593); MIR398a (SEQ ID NO:6594); MIR398b (SEQ ID NO:6595); MIR399a (SEQ ID NO:6596); MIR399b (SEQ ID NO:6597); MIR399c (SEQ ID NO:6598); MIR399d (SEQ ID NO:6599); MIR399e (SEQ ID NO:6600); MIR399f (SEQ ID NO:6601); MIR399g (SEQ ID NO:6602); MIR399h (SEQ ID NO:6603); MIR399i (SEQ ID NO:6604); MIR399j (SEQ ID NO:6605); MIR399k (SEQ ID NO:6606); MIR408 (SEQ ID NO:6607); MIR413 (SEQ ID NO:6608); MIR414 (SEQ ID NO:6609); MIR415 (SEQ ID NO:6610); MIR416 (SEQ ID NO:6611); MIR417 (SEQ ID NO:6612); MIR418 (SEQ ID NO:6613); MIR419 (SEQ ID NO:6614); MIR426 (SEQ ID NO:6615); MIR435 (SEQ ID NO:6616); MIR437 (SEQ ID NO:6617); MIR438 (SEQ ID NO:6618); MIR439a (SEQ ID NO:6619); MIR439b (SEQ ID NO:6620); MIR439c (SEQ ID NO:6621); MIR439d (SEQ ID NO:6622); MIR439e (SEQ ID NO:6623); MIR439f (SEQ ID NO:6624); MIR439g (SEQ ID NO:6625); MIR439h (SEQ ID NO:6626); MIR439i (SEQ ID NO:6627); MIR440 (SEQ ID NO:6628); MIR443 (SEQ ID NO:6629); MIR444a (SEQ ID NO:6630); MIR444b (SEQ ID NO:6631); MIR444c (SEQ ID NO:6632); MIR444d (SEQ ID NO:6633); MIR444e (SEQ ID NO:6634); MIR444f (SEQ ID NO:6635); MIR528 (SEQ ID NO:6636); MIR529a (SEQ ID NO:6637); MIR529b (SEQ ID NO:6638); MIR530 (SEQ ID NO:6639); MIR531a (SEQ ID NO:6640); MIR531b (SEQ ID NO:6641); MIR531c (SEQ ID NO:6642); MIR535 (SEQ ID NO:6643); MIR810a (SEQ ID NO:6644); MIR810b (SEQ ID NO:6645); MIR812a (SEQ ID NO:6646); MIR812b (SEQ ID NO:6647); MIR812c (SEQ ID NO:6648); MIR812d (SEQ ID NO:6649); MIR812e (SEQ ID NO:6650); MIR812f (SEQ ID NO:6651); MIR812g (SEQ ID NO:6652); MIR812h (SEQ ID NO:6653); MIR812i (SEQ ID NO:6654); MIR812j (SEQ ID NO:6655); MIR812k (SEQ ID NO:6656); MIR812l (SEQ ID NO:6657); MIR812m (SEQ ID NO:6658); MIR812n (SEQ ID NO:6659); MIR812o (SEQ ID NO:6660); MIR812p (SEQ ID NO:6661); MIR812q (SEQ ID NO:6662); MIR812r (SEQ ID NO:6663); MIR812s (SEQ ID NO:6664); MIR812t (SEQ ID NO:6665); MIR812u (SEQ ID NO:6666); MIR812v (SEQ ID NO:6667); MIR814a (SEQ ID NO:6668); MIR814b (SEQ ID NO:6669); MIR814c (SEQ ID NO:6670); MIR815a (SEQ ID NO:6671); MIR815b (SEQ ID NO:6672); MIR815c (SEQ ID NO:6673); MIR816 (SEQ ID NO:6674); MIR817 (SEQ ID NO:6675); MIR818a (SEQ ID NO:6676); MIR818b (SEQ ID NO:6677); MIR818c (SEQ ID NO:6678); MIR818d (SEQ ID NO:6679); MIR818e (SEQ ID NO:6680); MIR818f (SEQ ID NO:6681); MIR820a (SEQ ID NO:6682); MIR820b (SEQ ID NO:6683); MIR820c (SEQ ID NO:6684); MIR821a (SEQ ID NO:6685); MIR821b (SEQ ID NO:6686); MIR821c (SEQ ID NO:6687); MIR827 (SEQ ID NO:6688); MIR1319a (SEQ ID NO:6689); MIR1319b (SEQ ID NO:6690); MIR1320 (SEQ ID NO:6691); MIR1423 (SEQ ID NO:6692); MIR1424 (SEQ ID NO:6693); MIR1425 (SEQ ID NO:6694); MIR1426 (SEQ ID NO:6695); MIR1427 (SEQ ID NO:6696); MIR1428a (SEQ ID NO:6697); MIR1428b (SEQ ID NO:6698); MIR1428c (SEQ ID NO:6699); MIR1428d (SEQ ID NO:6700); MIR1428e (SEQ ID NO:6701); MIR1428f (SEQ ID NO:6702); MIR1428g (SEQ ID NO:6703); MIR1429 (SEQ ID NO:6704); MIR1430 (SEQ ID NO:6705); MIR1431 (SEQ ID NO:6706); MIR1432 (SEQ ID NO:6707); MIR1435 (SEQ ID NO:6708); MIR1436 (SEQ ID NO:6709); MIR1437 (SEQ ID NO:6710); MIR1437b (SEQ ID NO:6711); MIR1438 (SEQ ID NO:6712); MIR1439 (SEQ ID NO:6713); MIR1440a (SEQ ID NO:6714); MIR1440b (SEQ ID NO:6715); MIR1441 (SEQ ID NO:6716); MIR1442 (SEQ ID NO:6717); MIR1846a (SEQ ID NO:6718); MIR1846b (SEQ ID NO:6719); MIR1846c (SEQ ID NO:6720); MIR1846d (SEQ ID NO:6721); MIR1846e (SEQ ID NO:6722); MIR1847 (SEQ ID NO:6723); MIR1848 (SEQ ID NO:6724); MIR1849 (SEQ ID NO:6725); MIR1850 (SEQ ID NO:6726); MIR1851 (SEQ ID NO:6727); MIR1852 (SEQ ID NO:6728); MIR1853 (SEQ ID NO:6729); MIR1854 (SEQ ID NO:6730); MIR1855 (SEQ ID NO:6731); MIR1856 (SEQ ID NO:6732); MIR1857 (SEQ ID NO:6733); MIR1858a (SEQ ID NO:6734); MIR1858b (SEQ ID NO:6735); MIR1859 (SEQ ID NO:6736); MIR1860 (SEQ ID NO:6737); MIR1861a (SEQ ID NO:6738); MIR1861b (SEQ ID NO:6739); MIR1861c (SEQ ID NO:6740); MIR1861d (SEQ ID NO:6741); MIR1861e (SEQ ID NO:6742); MIR1861f (SEQ ID NO:6743); MIR1861g (SEQ ID NO:6744); MIR1861h (SEQ ID NO:6745); MIR1861i (SEQ ID NO:6746); MIR1861j (SEQ ID NO:6747); MIR1861k (SEQ ID NO:6748); MIR1861l (SEQ ID NO:6749); MIR1861m (SEQ ID NO:6750); MIR1861n (SEQ ID NO:6751); MIR1861o (SEQ ID NO:6752); MIR1862a (SEQ ID NO:6753); MIR1862b (SEQ ID NO:6754); MIR1862c (SEQ ID NO:6755); MIR1862d (SEQ ID NO:6756); MIR1862e (SEQ ID NO:6757); MIR1862f (SEQ ID NO:6758); MIR1862g (SEQ ID NO:6759); MIR1863a (SEQ ID NO:6760); MIR1863b (SEQ ID NO:6761); MIR1863c (SEQ ID NO:6762); MIR1864 (SEQ ID NO:6763); MIR1865 (SEQ ID NO:6764); MIR1866 (SEQ ID NO:6765); MIR1868 (SEQ ID NO:6766); MIR1869 (SEQ ID NO:6767); MIR1870 (SEQ ID NO:6768); MIR1871 (SEQ ID NO:6769); MIR1872 (SEQ ID NO:6770); MIR1873 (SEQ ID NO:6771); MIR1874 (SEQ ID NO:6772); MIR1875 (SEQ ID NO:6773); MIR1876 (SEQ ID NO:6774); MIR1877 (SEQ ID NO:6775); MIR1878 (SEQ ID NO:6776); MIR1879 (SEQ ID NO:6777); MIR1880 (SEQ ID NO:6778); MIR1881 (SEQ ID NO:6779); MIR1882a (SEQ ID NO:6780); MIR1882b (SEQ ID NO:6781); MIR1882c (SEQ ID NO:6782); MIR1882d (SEQ ID NO:6783); MIR1882e (SEQ ID NO:6784); MIR1882f (SEQ ID NO:6785); MIR1882g (SEQ ID NO:6786); MIR1882h (SEQ ID NO:6787); MIR1883a (SEQ ID NO:6788); MIR1883b (SEQ ID NO:6789); MIR2055 (SEQ ID NO:6790); MIR2090 (SEQ ID NO:6791); MIR2091 (SEQ ID NO:6792); MIR2092 (SEQ ID NO:6793); MIR2093 (SEQ ID NO:6794); MIR2094 (SEQ ID NO:6795); MIR2095 (SEQ ID NO:6796); MIR2096 (SEQ ID NO:6797); MIR2097 (SEQ ID NO:6798); MIR2098 (SEQ ID NO:6799); MIR2099 (SEQ ID NO:6800); MIR2100 (SEQ ID NO:6801); MIR2101 (SEQ ID NO:6802); MIR2102 (SEQ ID NO:6803); MIR2103 (SEQ ID NO:6804); MIR2104 (SEQ ID NO:6805); MIR2105 (SEQ ID NO:6806); MIR2106 (SEQ ID NO:6807); MIR2118a (SEQ ID NO:6808); MIR2118b (SEQ ID NO:6809); MIR2118c (SEQ ID NO:6810); MIR2118d (SEQ ID NO:6811); MIR2118e (SEQ ID NO:6812); MIR2118f (SEQ ID NO:6813); MIR2118g (SEQ ID NO:6814); MIR2118h (SEQ ID NO:6815); MIR2118i (SEQ ID NO:6816); MIR2118j (SEQ ID NO:6817); MIR2118k (SEQ ID NO:6818); MIR2118l (SEQ ID NO:6819); MIR2118m (SEQ ID NO:6820); MIR2118n (SEQ ID NO:6821); MIR2118o (SEQ ID NO:6822); MIR2118p (SEQ ID NO:6823); MIR2118q (SEQ ID NO:6824); MIR2118r (SEQ ID NO:6825); MIR2120 (SEQ ID NO:6826); MIR2121a (SEQ ID NO:6827); MIR2121b (SEQ ID NO:6828); MIR2122 (SEQ ID NO:6829); MIR2275a (SEQ ID NO:6830); MIR2275b (SEQ ID NO:6831); MIR2275c (SEQ ID NO:6832); MIR2275d (SEQ ID NO:6833); MIR2863a (SEQ ID NO:6834); MIR2863b (SEQ ID NO:6835); MIR2863c (SEQ ID NO:6836); MIR2864 (SEQ ID NO:6837); MIR2865 (SEQ ID NO:6838); MIR2866 (SEQ ID NO:6839); MIR2867 (SEQ ID NO:6840); MIR2868 (SEQ ID NO:6841); MIR2869 (SEQ ID NO:6842); MIR2870 (SEQ ID NO:6843); MIR2871a (SEQ ID NO:6844); MIR2871b (SEQ ID NO:6845); MIR2872 (SEQ ID NO:6846); MIR2873a (SEQ ID NO:6847); MIR2873b (SEQ ID NO:6848); MIR2873c (SEQ ID NO:6849); MIR2874 (SEQ ID NO:6850); MIR2875 (SEQ ID NO:6851); MIR2876 (SEQ ID NO:6852); MIR2877 (SEQ ID NO:6853); MIR2878 (SEQ ID NO:6854); MIR2879 (SEQ ID NO:6855); MIR2880 (SEQ ID NO:6856); MIR2905 (SEQ ID NO:6857); MIR2907a (SEQ ID NO:6858); MIR2907b (SEQ ID NO:6859); MIR2907c (SEQ ID NO:6860); MIR2907d (SEQ ID NO:6861); MIR2918 (SEQ ID NO:6862); MIR2919 (SEQ ID NO:6863); MIR2920 (SEQ ID NO:6864); MIR2921 (SEQ ID NO:6865); MIR2922 (SEQ ID NO:6866); MIR2923 (SEQ ID NO:6867); MIR2924 (SEQ ID NO:6868); MIR2925 (SEQ ID NO:6869); MIR2926 (SEQ ID NO:6870); MIR2927 (SEQ ID NO:6871); MIR2928 (SEQ ID NO:6872); MIR2929 (SEQ ID NO:6873); MIR2930 (SEQ ID NO:6874); MIR2931 (SEQ ID NO:6875); MIR2932 (SEQ ID NO:6876); MIR3979 (SEQ ID NO:6877); MIR3980a (SEQ ID NO:6878); MIR3980b (SEQ ID NO:6879); MIR3981 (SEQ ID NO:6880); MIR3982 (SEQ ID NO:6881); MIR5071 (SEQ ID NO:6882); MIR5072 (SEQ ID NO:6883); MIR5073 (SEQ ID NO:6884); MIR5074 (SEQ ID NO:6885); MIR5075 (SEQ ID NO:6886); MIR5076 (SEQ ID NO:6887); MIR5077 (SEQ ID NO:6888); MIR5078 (SEQ ID NO:6889); MIR5079a (SEQ ID NO:6890); MIR5079b (SEQ ID NO:6891); MIR5080 (SEQ ID NO:6892); MIR5081 (SEQ ID NO:6893); MIR5082 (SEQ ID NO:6894); MIR5083 (SEQ ID NO:6895); MIR5143a (SEQ ID NO:6896); MIR5143b (SEQ ID NO:6897); MIR5144 (SEQ ID NO:6898); MIR5145 (SEQ ID NO:6899); MIR5146 (SEQ ID NO:6900); MIR5147 (SEQ ID NO:6901); MIR5148a (SEQ ID NO:6902); MIR5148b (SEQ ID NO:6903); MIR5148c (SEQ ID NO:6904); MIR5149 (SEQ ID NO:6905); MIR5150 (SEQ ID NO:6906); MIR5151 (SEQ ID NO:6907); MIR5152 (SEQ ID NO:6908); MIR5153 (SEQ ID NO:6909); MIR5154 (SEQ ID NO:6910); MIR5155 (SEQ ID NO:6911); MIR5156 (SEQ ID NO:6912); MIR5157a (SEQ ID NO:6913); MIR5157b (SEQ ID NO:6914); MIR5158 (SEQ ID NO:6915); MIR5159 (SEQ ID NO:6916); MIR5160 (SEQ ID NO:6917); MIR5161 (SEQ ID NO:6918); MIR5162 (SEQ ID NO:6919); MIR5179 (SEQ ID NO:6920); MIR5337a (SEQ ID NO:6921); MIR5337b (SEQ ID NO:6922); MIR5338 (SEQ ID NO:6923); MIR5339 (SEQ ID NO:6924); MIR5340 (SEQ ID NO:6925); MIR5484 (SEQ ID NO:6926); MIR5485 (SEQ ID NO:6927); MIR5486 (SEQ ID NO:6928); MIR5487 (SEQ ID NO:6929); MIR5488 (SEQ ID NO:6930); MIR5489 (SEQ ID NO:6931); MIR5490 (SEQ ID NO:6932); MIR5491 (SEQ ID NO:6933); MIR5492 (SEQ ID NO:6934); MIR5493 (SEQ ID NO:6935); MIR5494 (SEQ ID NO:6936); MIR5495 (SEQ ID NO:6937); MIR5496 (SEQ ID NO:6938); MIR5497 (SEQ ID NO:6939); MIR5498 (SEQ ID NO:6940); MIR5499 (SEQ ID NO:6941); MIR5500 (SEQ ID NO:6942); MIR5501 (SEQ ID NO:6943); MIR5502 (SEQ ID NO:6944); MIR5503 (SEQ ID NO:6945); MIR5504 (SEQ ID NO:6946); MIR5505 (SEQ ID NO:6947); MIR5506 (SEQ ID NO:6948); MIR5507 (SEQ ID NO:6949); MIR5508 (SEQ ID NO:6950); MIR5509 (SEQ ID NO:6951); MIR5510 (SEQ ID NO:6952); MIR5511 (SEQ ID NO:6953); MIR5512a (SEQ ID NO:6954); MIR5512b (SEQ ID NO:6955); MIR5513 (SEQ ID NO:6956); MIR5514 (SEQ ID NO:6957); MIR5515 (SEQ ID NO:6958); MIR5516a (SEQ ID NO:6959); MIR5516b (SEQ ID NO:6960); MIR5517 (SEQ ID NO:6961); MIR5518 (SEQ ID NO:6962); MIR5519 (SEQ ID NO:6963); MIR5521 (SEQ ID NO:6964); MIR5522 (SEQ ID NO:6965); MIR5523 (SEQ ID NO:6966); MIR5524 (SEQ ID NO:6967); MIR5525 (SEQ ID NO:6968); MIR5526 (SEQ ID NO:6969); MIR5527 (SEQ ID NO:6970); MIR5528 (SEQ ID NO:6971); MIR5529 (SEQ ID NO:6972); MIR5530 (SEQ ID NO:6973); MIR5531 (SEQ ID NO:6974); MIR5532 (SEQ ID NO:6975); MIR5533 (SEQ ID NO:6976); MIR5534a (SEQ ID NO:6977); MIR5534b (SEQ ID NO:6978); MIR5535 (SEQ ID NO:6979); MIR5536 (SEQ ID NO:6980); MIR5537 (SEQ ID NO:6981); MIR5538 (SEQ ID NO:6982); MIR5539a (SEQ ID NO:6983); MIR5539b (SEQ ID NO:6984); MIR5540 (SEQ ID NO:6985); MIR5541 (SEQ ID NO:6986); MIR5542 (SEQ ID NO:6987); MIR5543 (SEQ ID NO:6988); MIR5544 (SEQ ID NO:6989); MIR5788 (SEQ ID NO:6990); MIR5789 (SEQ ID NO:6991); MIR5790 (SEQ ID NO:6992); MIR5791 (SEQ ID NO:6993); MIR5792 (SEQ ID NO:6994); MIR5793 (SEQ ID NO:6995); MIR5794 (SEQ ID NO:6996); MIR5795 (SEQ ID NO:6997); MIR5796 (SEQ ID NO:6998); MIR5797 (SEQ ID NO:6999); MIR5798 (SEQ ID NO:7000); MIR5799 (SEQ ID NO:7001); MIR5800 (SEQ ID NO:7002); MIR5801 (SEQ ID NO:7003); MIR5802 (SEQ ID NO:7004); MIR5803 (SEQ ID NO:7005); MIR5804 (SEQ ID NO:7006); MIR5805 (SEQ ID NO:7007); MIR5806 (SEQ ID NO:7008); MIR5807 (SEQ ID NO:7009); MIR5808 (SEQ ID NO:7010); MIR5809 (SEQ ID NO:7011); MIR5810 (SEQ ID NO:7012); MIR5811 (SEQ ID NO:7013); MIR5812 (SEQ ID NO:7014); MIR5813 (SEQ ID NO:7015); MIR5814 (SEQ ID NO:7016); MIR5815 (SEQ ID NO:7017); MIR5816 (SEQ ID NO:7018); MIR5817 (SEQ ID NO:7019); MIR5818 (SEQ ID NO:7020); MIR5819 (SEQ ID NO:7021); MIR5820 (SEQ ID NO:7022); MIR5821 (SEQ ID NO:7023); MIR5822 (SEQ ID NO:7024); MIR5823 (SEQ ID NO:7025); MIR5824 (SEQ ID NO:7026); MIR5825 (SEQ ID NO:7027); MIR5826 (SEQ ID NO:7028); MIR5827 (SEQ ID NO:7029); MIR5828 (SEQ ID NO:7030); MIR5829 (SEQ ID NO:7031); MIR5830 (SEQ ID NO:7032); MIR5831 (SEQ ID NO:7033); MIR5832 (SEQ ID NO:7034); MIR5833 (SEQ ID NO:7035); MIR5834 (SEQ ID NO:7036); MIR5835 (SEQ ID NO:7037); MIR5836 (SEQ ID NO:7038); MIR5837 (SEQ ID NO:7039); MIR6245 (SEQ ID NO:7040); MIR6246 (SEQ ID NO:7041); MIR6247 (SEQ ID NO:7042); MIR6248 (SEQ ID NO:7043); MIR6249a (SEQ ID NO:7044); MIR6249b (SEQ ID NO:7045); MIR6250 (SEQ ID NO:7046); MIR6251 (SEQ ID NO:7047); MIR6252 (SEQ ID NO:7048); MIR6253 (SEQ ID NO:7049); MIR6254 (SEQ ID NO:7050); MIR6255 (SEQ ID NO:7051); MIR6256 (SEQ ID NO:7052); MIR7692 (SEQ ID NO:7053); MIR7693 (SEQ ID NO:7054); MIR7694 (SEQ ID NO:7055); and MIR7695 (SEQ ID NO:7056).

When used, any generic description of an miRNA refers to any of its gene family members, unless otherwise indicated. A "gene family" refers to a group of genes that have the same miRNA coding sequence. Typically, members of a gene family are identified by a number or letter following the initial designation. For example, miR-16-1 and miR-16-2 are members of the miR-16 gene family and "mir-7" refers to miR-7-1, miR-7-2 and miR-7-3. Likewise, "let-7," for example, refers to let-7a-1, let7-a-2, let-7b, let-7c, let-7d, let-7e, let-7f-1, and let-7f-2.

The artificially-designed RNA disclosed herein can include RNA flanking sequences. "RNA flanking sequences" refer to nucleotide sequences including RNA processing elements that flank one or both sides of the Drosha cutting site.

"miRNA flanking sequence" refers to nucleotide sequences including miRNA processing elements. miRNA processing elements are the minimal nucleic acid sequences which contribute to the production of mature miRNA from precursor miRNA. Often these elements are located within a 40 nucleotide sequence that flanks a miRNA stem-loop structure. In some instances the miRNA processing elements are found within a stretch of nucleotide sequences of between 5 and 4,000 nucleotides in length that flank a miRNA stem-loop structure.

Thus, in some embodiments the flanking sequences are 5-4,000 nucleotides in length. As a result, the length of the precursor molecule may be, in some instances at least about 150 nucleotides or 270 nucleotides in length. The total length of the precursor molecule, however, may be greater or less than these values. In other embodiments the minimal length of the miRNA flanking sequence is 10, 20, 30, 40, 50, 60, 70, 80, 90, 100, 150, 200 and any integer there between. In other embodiments the maximal length of the miRNA flanking sequence is 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900 4,000 and any integer there between.

The miRNA flanking sequences may be native/endogenous miRNA flanking sequences or artificial miRNA flanking sequences. A native/endogenous miRNA flanking sequence is a nucleotide sequence that is ordinarily associated in naturally existing systems with miRNA sequences, i.e., these sequences are found within the genomic sequences surrounding the minimal miRNA hairpin in vivo. Artificial miRNA flanking sequences are nucleotide sequences that are not found to be flanking to miRNA sequences in naturally existing systems. The artificial miRNA flanking sequences may be flanking sequences found naturally in the context of other miRNA sequences. Alternatively they may be composed of minimal miRNA processing elements which are found within naturally occurring flanking sequences and inserted into other random nucleic acid sequences that do not naturally occur as flanking sequences or only partially occur as natural flanking sequences.

The miRNA flanking sequences within the precursor miRNA molecule may flank one or both sides of the stem-loop structure encompassing the miRNA sequence. Thus, one end (i.e., 5') of the stem-loop structure may be adjacent to a single flanking sequence and the other end (i.e., 3') of the stem-loop structure may not be adjacent to a flanking sequence. Particular structures have flanking sequences on both ends of the stem-loop structure. The flanking sequences may be directly adjacent to one or both ends of the stem-loop structure or may be connected to the stem-loop structure through a linker, additional nucleotides or other molecules.

In some instances the pri-miRNA molecule may include more than one stem-loop structure. The multiple stem-loop structures may be linked to one another through a linker, such as, for example, a nucleic acid linker or by a miRNA flanking sequence or other molecule or some combination thereof.

In particular embodiments, useful interfering RNAs can be designed with a number of software programs, e.g., the OligoEngine RNA design tool available at www.oligoengine.com. RNAs within this context can be about, e.g., 19-33 basepairs in length for the double-stranded portion. In some embodiments, the RNAs are hairpin RNAs having an about 19-33 bp stem and an about 4-34 nucleotide loop. Particular RNAs are highly specific for a region of a target gene and may comprise 19-33 bp fragments of a target gene mRNA that has at least one, at least two, or at least three, by mismatches with a nontargeted gene-related sequence. In some embodiments, the RNAs do not bind to RNAs having more than 3 mismatches with the target region.

The artificial RNAs disclosed herein are formed from a polymer of nucleotides (i.e. molecules comprising a sugar (e.g. ribose) linked to a phosphate group and to an exchangeable organic base, which is either a substituted pyrimidine (e.g. cytosine (C), or uracil (U)) or a substituted purine (e.g. adenine (A) or guanine (G)). As used herein, the term nucleotides also can include polynucleosides (i.e. a polynucleotide minus the phosphate) and any other organic base containing polymer.

The artificial miRNAs can also encompass nucleotides with substitutions or modifications, such as in the bases and/or sugars. Modified bases include any base that is chemically distinct from the naturally occurring bases typically found in RNA (C, G, A, and U), but which share basic chemical structures with these naturally occurring bases. The modified nucleotide base may be, for example, dihydrouracil, pseudouracil, 2-thiouracil, 4-thiouracil, 5-aminouracil, 5-($C_1$-$C_6$)-alkyluracil, 5-($C_2$-$C_6$)-alkenyluracil, 5-($C_2$-$C_6$)-alkynyluracil, 5-(hydroxymethyl)uracil, 5-chlorouracil, 5-fluorouracil, 5-bromouracil, 5-hydroxycytosine, 5-($C_1$-$C_6$)-alkylcytosine, 5-($C_2$-$C_6$)-alkenylcytosine, 5-($C_2$-$C_6$)-alkynylcytosine, 5-chlorocytosine, 5-fluorocytosine, 5-bromocytosine, $N^2$-dimethylguanine, 2,4-diamino-purine, 8-azapurine, a substituted 7-deazapurine, 7-deaza-7-substituted and/or 7-deaza-8-substituted purine, 5-hydroxymethylcytosine, N4-alkylcytosine, N4-ethylcytosine, 5-hydroxydeoxycytidine, 5-hydroxymethyldeoxycytidine, N4-alkyldeoxycytidine, N4-ethyldeoxycytidine, 6-thiodeoxyguanosine, deoxyribonucleosides of nitropyrrole, C5-propynylpyrimidine, diaminopurine, 2,6-diaminopurine, inosine, 5-methylcytosine, 2-aminopurine, 2-amino-6-chloropurine, hypoxanthine or other modifications of a natural nucleoside bases.

The artificial RNAs can also encompass various chemical modifications and substitutions, in comparison to natural RNA involving phosphodiester internucleotide bridges and/or β-D-ribose units. Replacing a phosphodiester bridge located at the 3' and/or the 5' end of a nucleotide can make artificial RNAs disclosed herein more resistant to degradation (i.e., are stabilized). Exemplary modified internucleotide bridges include phosphorothioate, phosphorodithioate, $NR^{1R2}$-phosphoramidate, boranophosphate, α-hydroxybenzyl phosphonate, phosphate-($C_1$-$C_{21}$)—O-alkyl ester, phosphate-[($C_6$-$C_{12}$)aryl-($C_1$-$C_{21}$)—O-alkyl]ester, ($C_1$-$C_8$)alkylphosphonate and/or ($C_6$-$C_{12}$)arylphosphonate bridges, ($C_7$-$C_{12}$)-α-hydroxymethyl-aryl, wherein ($C_6$-$C_{12}$)aryl, ($C_6$-$C_{20}$) aryl and ($C_6$-$C_{14}$)aryl are optionally substituted by halogen, alkyl, alkoxy, nitro, cyano, and where $R^1$ and $R^2$ are, independently of each other, hydrogen, ($C_1$-$C_{18}$)-alkyl, ($C_6$-$C_{20}$)-aryl, ($C_6$-$C_{14}$)-aryl-($C_1$-$C_8$)-alkyl, hydrogen, ($C_1$-$C_8$)-alkyl, ($C_1$-$C_4$)-alkyl and/or methoxyethyl, or $R^1$ and $R^2$ form, together with the nitrogen atom carrying them, a 5-6-membered heterocyclic ring which can additionally contain a further heteroatom from the group O, S and N. Dephospho bridges can also be used. Dephospho bridges are described, for example, in Uhlmann and Peyman in "Methods in Molecular Biology", Vol. 20, "Protocols for Oligonucleotides and Analogs", Agrawal, Ed., Humana Press, Totowa 1993, Chapter 16, pp. 355 ff). Exemplary dephospho bridges include formacetal, 3'-thioformacetal, methylhydroxylamine, oxime, methylenedimethyl-hydrazo, dimethylenesulfone and/or silyl groups.

Beta-ribose units can be replaced by modified sugar units such as 3-D-ribose, β-D-2'-deoxyribose, L-2'-deoxyribose, 2'-F-2'-deoxyribose, 2'-F-arabinose, 2'-O—($C_1$-$C_6$)alkyl-ribose, 2'-O—($C_1$-$C_6$)alkyl-ribose, 2'-O-methylribose, 2'-O—($C_2$-$C_6$)alkenyl-ribose, 2'-[O—($C_1$-$C_6$)alkyl-O—($C_1$-$C_6$) alkyl]-ribose, 2'-$NH_2$-2'-deoxyribose, β-D-xylo-furanose, α-arabinofuranose, 2,4-dideoxy-β-D-erythro-hexo-pyranose or carbocyclic and/or open-chain sugar analogs and/or bicyclosugar analogs.

Sugar phosphate units from the sugar phosphate backbone can also be replaced by other units such as "morpholino-derivative" oligomers (see, for example, Stirchak et al. (1989) Nucleic Acids Res 17:6129-41); polyamide nucleic acids (PNA; see, for example, Nielsen et al. (1994) Bioconjug Chem 5:3-7) such as by 2-aminoethylglycine; peptide nucleic acids with phosphate groups (PHONA); locked nucleic acids (LNA); and/or nucleotides having backbone sections with alkyl linkers or amino linkers. Alkyl linkers can be branched or unbranched, substituted or unsubstituted, and chirally pure or a racemic mixture.

Artificial RNAs disclosed herein can also be conjugated to lipophilic or lipid moieties. Exemplary lipophilic or lipid moieties include cholesteryls, modified cholesteryls, cholesterol derivatives, reduced cholesterols, substituted cholesterols, cholestans, $C_{1-6}$ alkyl chains, cholic acid, taurocholic acid, deoxycholate, oleyl litocholic acid, oleoyl cholenic acid, glycolipids, phospholipids, sphingolipids, isoprenoids, saturated fatty acids, unsaturated fatty acids or fatty acid esters. The lipophilic or lipid moieties can be attached via any suitable direct or indirect linkage such as, without limitation, by an ester or an amide. Linkages can include spacer moieties, for example one or more nucleotide residues, oligoethyleneglycol, triethyleneglycol, hexaethylenegylcol or an alkanediol, such as butanediol.

Artificial RNAs disclosed herein can also be conjugated to Nuclear Localization Signals (NLS). "Nuclear localization signals" are sequences (in some embodiments amino acid sequences) that can direct artificial RNAs in the cytoplasm of a cell across the nuclear membrane and into the nucleus of the cell. A nuclear localization signal can also target the exterior surface of a cell. Thus, a single nuclear localization signal can direct the artificial RNA with which it is associated to the exterior of a cell and to the nucleus of a cell. Nuclear localization signals are generally basic, comprise a short sequence of 4-8 amino acids and are typically rich in lysine and arginine residues while also often comprising proline residues.

While particular RNA sequences are described, the current disclosure also encompasses RNA sequences that hybridize with the specifically disclosed RNA sequences. An RNA sequence "hybridizes" to another RNA sequences when a single stranded form of the RNA sequence anneals to the other RNA sequence under the appropriate conditions of temperature and solution ionic strength. Hybridization and washing conditions are well known and exemplified in Sambrook, J., Fritsch, E. F. and Maniatis, T. Molecular Cloning: A Laboratory Manual, Second Ed., Cold Spring Harbor Laboratory Press, Cold Spring Harbor (1989), particularly Chapter 11 and Table 11.1 therein (incorporated by reference herein for its teachings regarding the same). The conditions of temperature and ionic strength determine the "stringency" of the hybridization. Stringency conditions can be adjusted to screen for moderately similar RNA sequences to highly similar RNA sequences. Post-hybridization washes determine stringency conditions. One set of hybridization conditions to demonstrate that RNA sequences hybridize uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. Stringent conditions use higher temperatures in which the washes are identical to those above except for the temperature of the final two 30 min washes in 0.2× SSC, 0.5% SDS is increased to 60° C. Highly stringent conditions use two final washes in 0.1 SSC, 0.1% SDS at 65° C. Those of ordinary skill in the art will recognize that these temperature and wash solution salt concentrations may be adjusted as necessary according to factors such as the length of the tested RNA sequences.

RNA sequences that share a % identity with the RNA sequences explicitly disclosed herein are also within the scope of the present disclosure. The % identity is at least 90%, at least 91%, at least 92%, at least 93%, at least 94%, at least 95%, at least 96%, at least 97%, at least 98% or at least 99%. As is known in the art, "% identity" refers to a relationship between two or more RNA sequences, as determined by comparing the sequences. In the art, "identity" also means the degree of sequence relatedness between RNA sequences as determined by the match between strings of such sequences. "Identity" (often referred to as "similarity") can be readily calculated by known methods, including (but not limited to) those described in: Computational Molecular Biology (Lesk, A. M., ed.) Oxford University Press, NY (1988); Biocomputing: Informatics and Genome Projects (Smith, D. W., ed.) Academic Press, NY (1994); Computer Analysis of Sequence Data, Part I (Griffin, A. M., and Griffin, H. G., eds.) Humana Press, NJ (1994); Sequence Analysis in Molecular Biology (Von Heijne, G., ed.) Academic Press (1987); and Sequence Analysis Primer (Gribskov, M. and Devereux, J., eds.) Oxford University Press, NY (1992), each incorporated by reference herein for its teachings regarding the same. Preferred methods to determine identity are designed to give the best match between the sequences tested. Methods to determine identity and similarity are codified in publicly available computer programs. Sequence alignments and percent identity calculations may be performed using the Megalign program of the LASERGENE bioinformatics computing suite (DNASTAR, Inc., Madison, Wis.). Multiple alignment of the sequences can also be performed using the Clustal method of alignment (Higgins and Sharp (1989) CABIOS. 5:151-153, incorporated by reference herein for its teaching regarding the same) with default parameters (GAP PENALTY=10, GAP LENGTH PENALTY=10). Relevant programs also include the GCG suite of programs (Wisconsin Package Version 9.0, Genetics Computer Group (GCG), Madison, Wis.); BLASTP, BLASTN, BLASTX (Altschul, et al., J. Mol. Biol. 215:403-410, 1990, incorporated by reference herein for its teaching regarding the same); DNASTAR (DNASTAR, Inc., Madison, Wis.); and the FASTA program incorporating the Smith-Waterman algorithm (Pearson, Comput. Methods Genome Res., [Proc. Int. Symp.] (1994), Meeting Date 1992, 111-20. Editor(s): Suhai, Sandor. Publisher: Plenum, New York, N.Y. incorporated by reference herein for its teaching regarding the same). Within the context of this disclosure, and where not otherwise specified, it will be understood that where sequence analysis software is used for analysis, the results of the analysis are based on the "default values" of the program referenced. As used herein "default values" will mean any set of values or parameters which originally load with the software when first initialized.

IV. Production of Artificial RNAs and/or Drosha Protein

General texts which describe molecular biological techniques to form nucleotide sequences and proteins include Sambrook, Molecular Cloning: a Laboratory Manual (2nd ed.) Vols. 1-3, Cold Spring Harbor Laboratory, (1989); Current Protocols in Molecular Biology Ausubel, ed. John Wiley & Sons, Inc., New York (1997); Laboratory Techniques in Biochemistry and Molecular Biology: Hybridization with Nucleic Acid Probes, Part 1. Theory and Nucleic Acid Preparation, P. Tijssen, ed. Elsevier, N.Y. (1993); Berger and Kimmel, Guide to Molecule Cloning Techniques Methods in Enzymology volume 152 Academic Press, Inc., San Diego, Calif. These texts describe the synthesis of nucleic acids and proteins as well as mutagenesis, the use of vectors, promoters and many other relevant topics related to generation and expression of genes encoding RNA, miRNA and protein. Techniques for isolation, purification and manipulation of nucleic acids, RNA, miRNA, genes, and proteins such as subcloning into expression vectors, labeling probes, and nucleotide hybridization are also described in the texts above and are well known to one of ordinary skill in the art.

The RNAs (including, without limitation, artificial RNAs, miRNAs and artificial miRNAs) and proteins disclosed herein can be formed by any technique known to one of ordinary skill in the art, including by chemical synthesis, enzymatic production or recombinant methods.

Chemical synthesis can be achieved by the diester method, the triester method, the phosphorylase method and/or by solid-phase chemistry. For example, chemical synthesis of RNAs can be performed using phosphotriester, phosphite or phosphoramidite chemistry and solid phase techniques such as described in EP 266,032 or via deoxynucleoside H-phosphonate intermediates as described in U.S. Pat. No. 5,705,629, each incorporated herein by reference for their teachings regarding the same.

A non-limiting example of enzymatic production includes amplification reactions such as polymerase chain reactions (PCR; see for example, U.S. Pat. Nos. 4,683,202 and 4,682,195, each incorporated by reference for their teachings regarding the same), or enzymatic synthesis as described in U.S. Pat. No. 5,645,897, incorporated by reference herein for its teachings regarding the same.

Recombinant RNAs and recombinant proteins include those produced from cells transformed by an exogenous DNA construct encoding the desired RNA or protein. Recombinant production methods are also well known in the art. For example, RNA molecules or proteins can be encoded by a nucleic acid molecule within a vector. The term "vector" refers to a carrier nucleic acid molecule into which a nucleic acid sequence can be inserted for introduction into a cell where it can be replicated. Vectors include plasmids, cosmids, viruses (bacteriophage, animal viruses, and plant viruses), and artificial chromosomes (e.g., YACs). One of ordinary skill in the art is well equipped to construct appropriate vectors through standard recombinant techniques. In addition to encoding RNA or proteins as disclosed herein, vectors can also encode sequences such as tags or targeting molecules. Targeting molecules can direct expressed RNA or protein to a particular location in a cell, to an organ, tissue, distant cell, or other location in a subject's body.

There are a number of ways in which vectors can be introduced into cells. Exemplary methods include microinjection, electroporation, lipid transfection, liposome mediated transfection, calcium phosphate transfection, calcium phosphate precipitation, DEAE-dextran followed by polyethylene glycol, sonic loading, microprojectile bombardment; or agitation with silicon carbide fibers. Recombinant methods can also be performed in cell free systems so long as the reagents for generating the RNA molecule are present. Additional methods for artificial RNA synthesis can be found in, without limitation, U.S. Pat. Nos. 4,659,774; 4,704,362; 4,816,571; 4,959,463; 5,141,813; 5,221,619; 5,264,566; 5,428,148; and 5,554,744; 5,574,146; 5,583,013; and 5,602,244 each of which is incorporated by reference herein for their teachings regarding the same.

V. Methods of Use

RNA, including miRNA, have been implicated in a wide variety of diseases and disorders. miRNA, artificial miRNA and Drosha up- and down-regulation disclosed herein can be used in therapeutic applications directed to, without limitation, acne, ADHD, adult-onset diabetes, age spots, age-related hearing loss, age-related macular degeneration, age-related vision change, AIDS, alcohol withdrawal, alcoholism, allergic rhinitis, allergies, alopecia, altitude sickness, Alzheimer's disease, amyotrophic lateral sclerosis (ALS), anemia, aneurism, angina, anxiety disorder, aplastic anemia, areata, arthritis, asthma, atherosclerosis, athlete's foot, atopic dermatitis, atrial fibrillation, autoimmune disease, Behcet's syndrome, Bell's palsy, bipolar disorder, bone disease, bradycardia, cardiovascular disease, cataracts, celiac disease, cerebral palsy, chloasma, congestive heart failure, conjunctivitis, cornea keratitis, Crohn's disease, cystic fibrosis, dandruff, dementia, depressive disorders, dermatitis, diabetes, diabetes mellitus, type 1, diabetes mellitus, type 2, dry-eye syndrome, dry skin, dysthymia, eclampsia, eczema, endocarditis, endometriosis, enlarged prostate, epilepsy, erectile dysfunction, essential tremor, fibroids, fibromyalgia, glaucoma, Graves disease, Guillain-Barre syndrome, hemophilia, high blood pressure, high cholesterol, Huntington's disease, hyperthyroidism, hypoparathyroidism, hypothyroidism, immune thrombocytopenic purpura, inflammatory bowel disease, insomnia, irritable bowel syndrome, juvenile arthritis, keloids, lactose intolerance, liver spots, locomotor dysfunction, lupus, major depression, manic depression, melasma, memory loss, multiple sclerosis, muscular dystrophy, myasthenia gravis, myocardial infarction, myocarditis, myopia, narcolepsy, obesity, obsessive-compulsive disorder, optic nerve swelling, osteoarthritis, osteoporosis, Paget's disease, Parkinson's disease, pain, panic disorder, peripheral vascular disease, pernicious anemia, phobia, pigmentation disorders, post-partum depression, post-traumatic stress disorder, preeclampsia, pregnancy-induced hypertension, presbyopia, psoriasis, psoriatic arthritis, renal failure, restless legs syndrome, Reye's syndrome, rheumatoid arthritis, rosacea, scars, schizophrenia, sciatica, scleroderma, seizures, sexual dysfunction, sickle cell anemia, skin blemishes, spider veins, sterility, stroke, sun-damaged skin, systemic lupus, Tay-Sachs disease, tendonitis, tennis elbow, tension headache, thrombocytopenia, tinnitus, ulcer, urinary incontinenece, varicose veins, vitiligo, and wrinkles.

miRNA, artificial miRNA and Drosha up- and down-regulation disclosed herein can be used in therapeutic applications directed to treatment of various cancers including, without limitation, bladder cancer, blood cancer, bone cancer, bone marrow cancer, brain cancer, breast cancer, colon cancer, esophageal cancer, gastrointestinal cancer, gum cancer, head cancer, kidney cancer, liver cancer, lung cancer, nasopharynx cancer, neck cancer, ovarian cancer, prostate cancer, skin cancer, stomach cancer, testicular cancer, tongue cancer, uterine cancer, neoplastic cancer, malignant cancer; carcinomas; sarcomas; lymphomas; Hodgkin's lymphomas; non-Hodgkin's lymphomas; and leukemias.

miRNA, artificial miRNA and Drosha up- and down-regulation disclosed herein can be used in therapeutic applications directed to infectious diseases, i.e., those arising from the presence of a foreign microorganism in the body. A microbial antigen, as used herein, is an antigen of a microorganism. Microorganisms include but are not limited to, infectious viruses, infectious bacteria, and infectious fungi.

Examples of infectious viruses include: Retroviridae (e.g. human immunodeficiency viruses, such as HIV-1 (also referred to as HTLV-III, LAV or HTLV-III/LAV, or HIV-III; and other isolates, such as HIV-LP; Picornaviridae (e.g. polio viruses, hepatitis A virus; enteroviruses, human Coxsackie viruses, rhinoviruses, echoviruses); Calciviridae (e.g. strains that cause gastroenteritis); Togaviridae (e.g. equine encephalitis viruses, rubella viruses); Flaviridae (e.g. dengue viruses, encephalitis viruses, yellow fever viruses); Coronoviridae (e.g. coronaviruses); Rhabdoviradae (e.g. vesicular stomatitis viruses, rabies viruses); Filoviridae (e.g. ebola viruses); Paramyxoviridae (e.g. parainfluenza viruses, mumps virus, measles virus, respiratory syncytial virus); Orthomyxoviridae (e.g. influenza viruses); Bungaviridae (e.g. Hantaan viruses, bunga viruses, phleboviruses and Nairo viruses); Arena viridae (hemorrhagic fever viruses); Reoviridae (e.g. reoviruses, orbiviurses and rotaviruses); Birnaviridae; Hepadnaviridae (Hepatitis B virus); Parvovirida (parvoviruses); Papovaviridae (papilloma viruses, polyoma viruses); Adenoviridae (most adenoviruses); Herpesviridae (herpes simplex virus (HSV) 1 and 2, varicella zoster virus, cytomegalovirus (CMV), herpes virus; Poxyiridae (variola viruses, vaccinia viruses, pox viruses); and Iridoviridae (e.g. African swine fever virus); and unclassified viruses (e.g. the etiological agents of Spongiform encephalopathies, the agent of delta hepatitis (thought to be a defective satellite of hepatitis B virus), the agents of non-A, non-B hepatitis (class 1=internally transmitted; class 2=parenterally transmitted (i.e. Hepatitis C); Norwalk and related viruses, and astroviruses).

Examples of infectious bacteria include: *Helicobacter pyloris, Borelia burgdorferi, Legionella pneumophilia, Mycobacteria* (M.) sps (e.g. *M. tuberculosis, M. avium, M. intracellulare, M. kansaii, M. gordonae*), *Staphylococcus aureus, Neisseria* (N.) *gonorrhoeae, N. meningitidis, Listeria monocytogenes, Streptococcus* (S.) *pyogenes* (Group A S.), *S. agalactiae* (Group B S.), *S.* (*viridans* group), *S. faecalis, S. bovis, S. pneumoniae*, pathogenic *Campylobacter* sp., *Enterococcus* sp., *Haemophilus influenzae, Bacillus antracis, corynebacterium diphtheriae, corynebacterium* sp., *Erysipelothrix rhusiopathiae, Clostridium perfringers, Clostridium tetani, Enterobacter aerogenes, Klebsiella pneumoniae, Pasteurella multocida, Bacteroides* sp., *Fusobacterium nucleatum, Treponema palladium, Treponema pertenue, Leptospira, Rickettsia*, and *Actinomyces israelli*.

Examples of infectious fungi include: *Cryptococcus neoformans, Histoplasma capsulatum, Coccidioides immitis, Blastomyces dermatitidis, Chlamydia trachomatis, Candida albicans*. Other infectious organisms (i.e., protists) include: *Plasmodium* such as *Plasmodium* (P.) *falciparum, P. malariae, P. ovale*, and *P. vivax* and *Toxoplasma gondii*.

Other exemplary infections include athlete's foot, chickenpox, common cold, diarrheal diseases, flu, genital herpes, malaria, meningitis, pneumonia, sinusitis, various skin diseases, strep throat, tuberculosis, urinary tract infections, vaginal infections, viral hepatitis, and prion diseases.

miRNAs that up-regulate cell growth include miR-31, miR-150, miR-187, miR-125a, miR-190, miR-191, miR-193, miR-204, and miR-218. Accordingly, in conditions with less than optimal cell growth, such as degenerative diseases, including neural degeneration, multiple sclerosis, or macular degeneration, it would be beneficial to up-regulate these miRNAs. Of these miRNAs, for example, miR-31 and miR-150 are semi-rigid and miR-193 is mis-matched. When an up-regulation of cell growth is intended, mis-matches at positions 5 and/or 9-12 from the Drosha cutting site of these miRNAs can be removed to render them less susceptible to fluctuating Drosha expression levels. When a down-regulation of cell growth is intended, additional mis-matches can be introduced at positions 5 and/or 9-12 from the Drosha cutting site to render the miRNA more susceptible to fluctuating Drosha expression levels.

miRNAs that down-regulate cell growth include miR-21 and miR-24. Of these miRNAs, miR-21 is semi-rigid and miR-24 is rigid. Accordingly, in conditions with excessive cell growth, such as breast cancer, cervical cancer, colon cancer, liver cancer, lung cancer, prostate cancer, skin cancer, stomach cancer, and testicular cancer, it would be beneficial to up-regulate these miRNAs. When a down-regulation of cell growth is intended, mis-matches at positions 5 and/or 9-12 from the Drosha cutting site of these miRNAs can be removed to render them less susceptible to fluctuating Drosha expression levels. When an up-regulation of cell growth is intended, additional mis-matches can be introduced at positions 5 and/or 9-12 from the Drosha cutting site to render the miRNA more susceptible to fluctuating Drosha expression levels.

miRNAs such as miR-7, miR-19a, miR-23, miR-24, miR-27a, miR-31, miR-32, miR-134, miR-140, miR-150, miR-192, and miR-193 reduce cell viability. Of these miRNAs, for example, miR-7 and miR-23 are semi-rigid, and miR-19a is rigid. In conditions related to increased cell viability, such as cancerous tumors, hyperthyroidism, overactive adrenal gland, and hyperlipidemia, it would be beneficial to up-regulate these miRNAs in order to reduce cell viability. When a down-regulation of cell viability is intended, mis-matches at positions 5 and/or 9-12 from the Drosha cutting site of these miRNAs can be removed to render them less susceptible to fluctuating Drosha expression levels. When an up-regulation of cell viability is intended, additional mis-matches can be introduced at positions 5 and/or 9-12 from the Drosha cutting site to render the miRNA more susceptible to fluctuating Drosha expression levels.

miRNAs such as miR-107, miR-133, miR-137, miR-152, miR-155, miR-181a, miR-191, miR-203, and miR-215 increase cell viability. Of these miRNAs, for example, miR-155, miR-191, miR-203, and miR-215 are semi-rigid. Accordingly, in conditions with decreased cell viability, such as cirrhosis of the liver, HIV, and cell degeneration, it would be beneficial to up-regulate these miRNAs in order to increase cell viability. When an up-regulation of cell viability is intended, mis-matches at positions 5 and/or 9-12 from the Drosha cutting site of these miRNAs can be removed to render them less susceptible to fluctuating Drosha expression levels. When a down-regulation of cell viability is intended, additional mis-matches can be introduced at positions 5 and/or 9-12 from the Drosha cutting site to render the miRNA more susceptible to fluctuating Drosha expression levels.

An increase in the percentage of apoptotic cells is caused by miR-338, miR-27a, miR-128, miR-23a, miR-324, miR-22, miR-181a, mmu-miR-293, mmu-miR-412, miR-196, miR-31, Let-7d, miR-23b, mu-miR-290, miR-217, miR-199, miR-24, miR-214, and miR-198. Of these miRNAs, miR-23a and miR-338 are semi-rigid and miR-27a is quasi-rigid, for example. Accordingly, in conditions related to insufficient apoptosis, such as carcinomas, bone cancers, tumors, glioma, thyroid cancer, and throat cancer, it would be beneficial to up-regulate these miRNAs. When an up-regulation of apoptosis is intended, mis-matches at positions 5 and/or 9-12 from the Drosha cutting site of these miRNAs can be removed to render them less susceptible to fluctuating Drosha expression levels. When a down-regulation of apoptosis is intended, additional mis-matches can be introduced at positions 5 and/or 9-12 from the Drosha cutting site to render the miRNA more susceptible to fluctuating Drosha expression levels.

miRNAs that decrease the percentage of apoptotic cells include miR-105, miR-34a, miR-96, mmu-miR-292, miR-126, miR-137, and miR-101. Of these miRNAs, miR-96 and miR-126 are semi-rigid. Accordingly, in conditions related to excessive apoptosis, such as HIV, neurodegenerative diseases, hematologic diseases, and tissue damage, it would be beneficial to up-regulate these miRNAs. When a down-regulation of apoptosis is intended, mis-matches at positions 5 and/or 9-12 from the Drosha cutting site of these miRNAs can be removed to render them less susceptible to fluctuating Drosha expression levels. When an up-regulation of apoptosis is intended, additional mis-matches can be introduced at positions 5 and/or 9-12 from the Drosha cutting site to render the miRNA more susceptible to fluctuating Drosha expression levels.

miRNAs including miR-31 and miR-214 reduce cell proliferation. Of these miRNAs, miR-31 is semi-rigid, and miR-214 is mis-matched. When a down-regulation of cell proliferation is intended, mis-matches at positions 5 and/or 9-12 from the Drosha cutting site of these miRNAs can be removed to render them less susceptible to fluctuating Drosha expression levels. When an up-regulation of cell proliferation is intended, additional mis-matches can be introduced at positions 5 and/or 9-12 from the Drosha cutting site to render the miRNA more susceptible to fluctuating Drosha expression levels.

An increase in cell proliferation is caused by miRNAs such as miR-7, miR-1-2, miR-148, miR-195, miR-196, miR-199a, miR-204, miR-210, miR-211, miR-212, miR-215, miR-216, miR-218, miR-296, and miR-321. Of these miRNAs, miR-7, miR-148, and miR-195 are semi-rigid, for example. When an up-regulation of cell proliferation is intended, mis-matches at positions 5 and/or 9-12 from the Drosha cutting site of these miRNAs can be removed to render them less susceptible to fluctuating Drosha expression levels. When a down-regulation of cell proliferation is intended, additional mis-matches can be introduced at positions 5 and/or 9-12 from the Drosha cutting site to render the miRNA more susceptible to fluctuating Drosha expression levels.

miRNAs such as miR-100, miR-130a, miR-211, miR-212, miR-213, miR-215, miR-224, miR-292, miR-320, miR-324, miR-325, miR-330, miR-338, miR-369, miR-370, and miR-99a increase the proliferation of Prostate 22Rv1 cells. Of these miRNAs, miR-211 and miR-212 are quasi-rigid. When an up-regulation of cell proliferation is intended, mis-matches at positions 5 and/or 9-12 from the Drosha cutting site of these miRNAs can be removed to render them less susceptible to fluctuating Drosha expression levels. When a down-regulation of cell proliferation is intended, additional mis-matches can be introduced at positions 5 and/or 9-12 from the Drosha cutting site to render the miRNA more susceptible to fluctuating Drosha expression levels.

miRNAs such as miR-10b and miR-152 decrease proliferation of Prostate 22Rv1 cells. Of these miRNAs, miR-10b is rigid, and miR-152 is semi-rigid. When a down-regulation of cell proliferation is intended, mis-matches at positions 5 and/or 9-12 from the Drosha cutting site of these miRNAs can be removed to render them less susceptible to fluctuating Drosha expression levels. When an up-regulation of cell proliferation is intended, additional mis-matches can be introduced at positions 5 and/or 9-12 from the Drosha cutting site to render the miRNA more susceptible to fluctuating Drosha expression levels.

miRNAs including miR-210 and miR-216 increase the proliferation of skin TE354T cells. Of these miRNAs, miR-210 and miR-216 are quasi-rigid. When an up-regulation of cell proliferation is intended, mis-matches at positions 5 and/or 9-12 from the Drosha cutting site of these miRNAs can be removed to render them less susceptible to fluctuating Drosha expression levels. When a down-regulation of cell proliferation is intended, additional mis-matches can be introduced at positions 5 and/or 9-12 from the Drosha cutting site to render the miRNA more susceptible to fluctuating Drosha expression levels.

miRNAs including Let-7a, Let-7b, Let-7g, miR-10a, miR-10b, miR-133b, miR-155, miR-15a, miR-16, miR-181a, miR-182, miR-193, miR-194, miR-196, mi-204, miR-23a, miR-24, miR-25, miR-92, and miR-95 decrease proliferation of skin TE354T cells. Of these miRNAs, let-7a is semi-rigid, and miR-181a is quasi-rigid. When a down-regulation of cell proliferation is intended, mis-matches at positions 5 and/or 9-12 from the Drosha cutting site of these miRNAs can be removed to render them less susceptible to fluctuating Drosha expression levels. When an up-regulation of cell proliferation is intended, additional mis-matches can be introduced at positions 5 and/or 9-12 from the Drosha cutting site to render the miRNA more susceptible to fluctuating Drosha expression levels.

miRNAs including miR-216, miR-217, and miR-294 increase the proliferation of breast MCF12a cells. Of these miRNAs, miR-216 is quasi-rigid, and miR-217 is semi-rigid. When an up-regulation of cell proliferation is intended, mis-matches at positions 5 and/or 9-12 from the Drosha cutting site of these miRNAs can be removed to render them less susceptible to fluctuating Drosha expression levels. When a down-regulation of cell proliferation is intended, additional mis-matches can be introduced at positions 5 and/or 9-12 from the Drosha cutting site to render the miRNA more susceptible to fluctuating Drosha expression levels.

miRNAs including Let-7a, Let-7b-1, Let-7c, Let-7d, miR-10a, miR-10b, miR-133a, miR-152, miR-153, miR-155, miR-16, miR-181a, miR-183, miR-184, miR-186, miR-191, miR-200b, miR-412, and miR-9 decrease proliferation of breast MCF12a cells. Of these miRNAs, let-7c is quasi-rigid, miR-152 is semi-rigid, and miR-10a is rigid. When a down-regulation of cell proliferation is intended, mis-matches at positions 5 and/or 9-12 from the Drosha cutting site of these miRNAs can be removed to render them less susceptible to fluctuating Drosha expression levels. When an up-regulation of cell proliferation is intended, additional mis-matches can be introduced at positions 5 and/or 9-12 from the Drosha cutting site to render the miRNA more susceptible to fluctuating Drosha expression levels.

miRNAs including miR-129, miR-326, miR-331, miR-338, miR-341, miR-370, and miR-92 increase the proliferation of lung A549 cells. Of these miRNAs, mir-129 is semi-rigid, and miR-370 is quasi-rigid. When an up-regulation of cell proliferation is intended, mis-matches at positions 5 and/or 9-12 from the Drosha cutting site of these miRNAs can be removed to render them less susceptible to fluctuating Drosha expression levels. When a down-regulation of cell proliferation is intended, additional mis-matches can be introduced at positions 5 and/or 9-12 from the Drosha cutting site to render the miRNA more susceptible to fluctuating Drosha expression levels.

miRNAs such as Let-7a-1, miR-133a-2, miR-142, miR-187, miR-199a-1, miR-206, miR-211, miR-222, miR-223, miR-23b, miR-298, miR-328, miR-342, and miR-371 decrease proliferation of lung A549 cells. Of these miRNAs, miR-187 is semi-rigid, and miR-211 is quasi-rigid. When a down-regulation of cell proliferation is intended, mis-matches at positions 5 and/or 9-12 from the Drosha cutting site of these miRNAs can be removed to render them less susceptible to fluctuating Drosha expression levels. When an up-regulation of cell proliferation is intended, additional mis-matches can be introduced at positions 5 and/or 9-12 from the Drosha cutting site to render the miRNA more susceptible to fluctuating Drosha expression levels.

Lupus-related miRNAs include miR-301, miR-199, miR-95, miR-105, mu-miR-290, miR-215, miR-188, miR-186, miR-211, miR-331, miR-137, miR-21, miR-223, and miR-342. miRNAs that may be related to prion diseases include miR-95, miR-135a, miR-7, miR-9, miR-27a, miR-130a, miR-16, miR-26a, and miR-24. miRNAs that are potentially associated with stroke include Let-7F-2, miR-16, miR-138, miR-139, miR30A, miR-31, miR-140, miR-298, miR-28, and miR-291-5P.

An additional aspect of the current disclosure is the design of drugs for use in the central nervous system (anti-depressants; anti-anxiety; anti-Alzheimer's; anti-Parkinson's; etc.) that have low activity in the liver. These drugs would be RNA-based with mis-matches introduced at one or more of positions 5 and/or 9-12 from the Drosha cutting site. In particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

Orally-administered RNA-based therapeutics are processed through the liver before reaching other sites of action. Introduction of mis-matches at positions 5 and/or 9-12 from the Drosha cutting site can minimize the RNA's effect in the liver while maintaining an effect in other targets of interest with higher Drosha expression. Accordingly, these drugs would be RNA-based with mis-matches introduced at one or more of positions 5 and/or 9-12 from the Drosha cutting site. In particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

Alternatively, RNA-based drugs that target the liver could have mis-matches removed to increase potency in the liver. Such RNA-based drugs could be used as therapies for, without limitation, obesity, alcohol metabolism, altering drug processing and/or glycogen storage. In particular embodiments, these drugs would be RNA-based with mis-matches removed at one or more of positions 5 and/or 9-12 from the Drosha cutting site. In particular embodiments, 1, 2, 3, 4, or 5 mis-matches are removed at positions 5 and/or 9-12 from the Drosha cutting site. In particular embodiments, 1, 2 or 3 mis-matches are removed at positions 5 and/or 9-12 from the Drosha cutting site.

For applications where a local effect of an RNA therapy is desired, the secondary structure can be altered to minimize the effect on surrounding tissues relative to the target tissue. For example the intestine has high Drosha expression levels compared to the liver and pancreas, so a mismatched, highly mis-matched or fully mis-matched RNA administered to the intestine would show relatively high levels in the intestine, whereas any RNA that is diffused or transported to the liver and/or pancreas would have a minimal effect in the those organs, thus reducing the risk of side effects. Applications include obesity medications that inhibit uptake of nutrients by the intestine, as well as other gastric conditions, intestinal parasites, cancer, irritable bowel syndrome, lactose intolerance, etc. These drugs would be RNA-based with mis-matches introduced at one or more of positions 5 and/or 9-12 from the Drosha cutting site. In particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

As another example, the ovaries have relatively high drosha expression levels compared to the uterus. For RNA therapeutics specifically targeting the ovaries (such as potential fertility treatments) RNA can be designed with mis-matches incorporated to minimize the effect on the uterus as well as surrounding tissues, while still having an effect on the targeted ovaries. These drugs would be RNA-based with mis-matches introduced at one or more of positions 5 and/or 9-12 from the Drosha cutting site. In particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

As another example, Drosha levels vary throughout T-cell development, where young T-cells have high Drosha expression levels, which decrease as the T-cells mature. RNA therapeutics can be designed with or without mismatches in the positions 5 and/or 9-12 nucleotides from the Drosha cutting site to target mature or young T-cells respectively. This could be of importance in any therapeutic involving the immune response, such as AIDS, allergies, cancer, parasites, viral and bacterial infections, autoimmune diseases, etc. (e.g., the majority of all diseases). Embodiments targeting young T-cells would have mis-matches introduced at one or more of positions 5 and/or 9-12 from the Drosha cutting site. In particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site. In embodiments targeting mature T-cells, mis-matches would be removed at one or more of positions 5 and/or 9-12 from the Drosha cutting site. In particular embodiments, 1, 2, 3, 4, or 5 mis-matches are removed at positions 5 and/or 9-12 from the Drosha cutting site. In particular embodiments, 3, 4, or 5 mis-matches are removed at positions 5 and/or 9-12 from the Drosha cutting site.

In further examples, Drosha levels vary during many types of cellular differentiation (such as neuronal differentiation), with a maximum expression 6-12 days after differentiation begins. miRNAs for over expression can be designed (i) without mismatches in the 5, and 9-12 positions to maintain constant levels throughout the differentiation process, or (ii) alternatively with mismatches to maximize the effect specifically for the 6-12 day time point. In these embodiments, mis-matches would be removed at one or more of positions 5 and/or 9-12 from the Drosha cutting site to maintain constant levels. In particular embodiments, 1, 2, 3, 4, or 5 mis-matches are removed at positions 5 and/or 9-12 from the Drosha cutting site. In particular embodiments, 3, 4, or 5 mis-matches are removed at positions 5 and/or 9-12 from the Drosha cutting site. In further embodiments, mis-matches would be introduced at one or more of positions 5 and/or 9-12 from the Drosha cutting site to target the 6-12 day period. In these particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

The current disclosure also applies to the tissue culture environment. In the tissue culture environment several cell types are grown simultaneously in the same environment, e.g. embryonic stem cells are commonly grown on a layer of irradiated mouse embryonic fibroblasts. Depending on the stage the embryonic cells are in, RNA that are overexpressed can be tailored to minimize the effect on other cell types that are present.

As noted, many cancer cells have high Drosha expression levels. Accordingly, miRNA therapeutics can be designed that are maximally effective in the cancerous cells while having fewer effects in healthy cells. In these embodiments, the miRNA would have mis-matches introduced at one or more of positions 5 and/or 9-12 from the Drosha cutting site to target the cancer cells. In these particular embodiments, 1, 2, 3, 4, or 5 mis-matches are introduced at positions 5 and/or 9-12 from the Drosha cutting site. In particular embodiments, 3, 4, or 5 mis-matches are introduced at positions 5 and/or 9-12 from the Drosha cutting site.

In therapeutic applications, an effective amount of miRNA, artificial miRNA, Drosha protein or Drosha inhibitor can be administered to a subject in the form of an administered therapeutic and/or as part of a genetic therapy. An "effective amount" is the amount of miRNA, artificial miRNA, Drosha protein or Drosha inhibitor necessary to result in a desired physiological change in the subject. The term "therapeutically effective amount" is the amount of miRNA, artificial miRNA, Drosha protein or Drosha inhibitor necessary to achieve a desired effect with respect to a disease or condition. The therapeutically effective amount can, but need not, cure the disease or condition. For example, the therapeutically effective amount can provide a partial benefit, such as alleviation or improvement of at least one symptom of the disease or condition.

In the context of cancers, therapeutically effective amounts can inhibit tumor growth, inhibit cancer cell proliferation, prevent metastasis, reduce the number of metastases, induce cancer cell death, induce apoptosis of cancer cells, inhibit angiogenesis near cancer cells, reduce cancer-associated pain, reduce relapse or re-occurrence, induce chemo- or radiosensitivity in cancer cells and/or prolong a subject's life.

For administration, effective amounts and therapeutically effective amounts (referred to herein as doses) can be initially be estimated based on results from in vitro assays and/or animal model studies. For example, a dose can be formulated in animal models to achieve a circulating concentration range that includes the $IC_{50}$ as determined in cell culture. Such information can be used to more accurately determine useful doses in humans, veterinary animals (for example, dogs, cats and horses), livestock (for example, cattle, buffalo, sheep, pigs, goats, chickens), research animals (for example, monkeys, rats, mice, fish, flies and worms), other domesticated animals (for example, animals in zoos, circuses and aquariums including elephants, tigers, lions, sharks, rays and dolphins) and plants (all subjects herein).

The actual dosage amount administered to a particular subject can be determined by a physician, veterinarian or researcher taking into account parameters such as physical and physiological factors including body weight, severity of condition, type of disease, previous or concurrent therapeutic interventions, idiopathy of the subject and route of administration.

Useful doses often range from 0.1 to 5 mg/kg/day or from 0.5 to 1 mg/kg/day or from 0.1 to 5 µg/kg/day or from 0.5 to 1 µg/kg/day. In other non-limiting examples, a dose can comprise from 1 µg/kg/day, 5 µg/kg/day, 10 µg/kg/day, 50 µg/kg/day, 100 µg/kg/day, 200 µg/kg/day, 350 µg/kg/day, 500 µg/kg/day, 1 mg/kg/day, 5 mg/kg/day, 10 mg/kg/day, 50 mg/kg/day, 100 mg/kg/day, 200 mg/kg/day, 350 mg/kg/day, 500 mg/kg/day or 1000 mg/kg/day. Effective amounts and therapeutically effective amounts can be achieved by administering single or multiple doses during the course of a treatment regimen (days, weeks, months, etc.).

In certain embodiments, miRNA, artificial miRNA, Drosha protein, Drosha inducer or Drosha inhibitor are provided as part of pharmaceutical compositions. The pharmaceutical compositions can comprise, for example, at least 0.1% miRNA, artificial miRNA, Drosha protein or Drosha inhibitor. In other embodiments, the pharmaceutical composition can comprise between 2% to 75% of the weight of the unit, or between 25% to 60% of the weight of the unit miRNA, artificial miRNA, Drosha protein or Drosha inhibitor.

Pharmaceutical compositions can be formulated in any conventional manner using one or more physiologically acceptable carriers, diluents, excipients or auxiliaries which facilitate processing of miRNA, artificial miRNA, Drosha protein, Drosha inhibitor miRNA vectors, artificial miRNA vectors, Drosha protein vectors or Drosha inhibitor vectors (in the context of formulations, all hereafter collectively referred to as "the therapeutics") into preparations which can be used pharmaceutically. Proper formulation is dependent upon the route of administration chosen.

The therapeutics can be included within formulations for administration as free bases, neutral or as pharmaceutically acceptable salts. Pharmaceutically acceptable salts are those that substantially retain the biologic activity of free bases. Pharmaceutically acceptable salts, include the acid addition salts, e.g., those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in solvents than the corresponding free base forms.

The therapeutics can also be attached or conjugated to other chemical entities to increase cellular uptake. Exemplary chemical entities include acridine derivatives, 2-methoxy-6-chloro-9-aminoacridine, cross-linkers, psoralen derivatives, azidophenacyl, proflavin, azidoproflavin, metal complexes, EDTA-Fe(II), o-phenanthroline-Cu(I), porphyrin-Fe(II), alkylating moieties, endonucleases, artificial endonucleases, amino-1-hexanolstaphylococcal nuclease, alkaline phosphatase, terminal transferases, abzymes, cholesteryl moieties, lipophilic carriers, lipofectin, DOTMA, DOPE, DOTAP, peptide conjugates, long chain alcohols, phosphate esters, amino acids, mercapto groups, polylysine or other polyamines.

The therapeutics may particularly be administered in combination with a cationic amine such as poly (L-lysine) and/or may be conjugated to a chemical moiety, such as transferrin and/or cholesteryls. In particular embodiments, linking the therapeutics to a suitable array of mannose residues targets them to the liver.

In particular embodiments, the therapeutics can be introduced into cells by microinjection, electroporation, lipid transfection, liposome mediated transfection, calcium phosphate transfection, calcium phosphate precipitation, DEAE-dextran followed by polyethylene glycol, sonic loading, microprojectile bombardment, or agitation with silicon carbide fibers.

Certain aspects of the disclosure include contacting and introducing into a target cell a vector capable of expressing a pri-miRNA to regulate the expression of a target gene in the cell. The vector produces the pri-miRNA transcript, which is then processed into precursor microRNA in the cell, which is then processed to produce the mature functional miRNA which is capable of altering accumulation of a target protein in the target cell. Accumulation of the protein may be effected in a number of different ways. For instance the miRNA may directly or indirectly affect translation or may result in cleavage of the mRNA transcript or even effect stability of the protein being translated from the target mRNA. MiRNA may function through a number of different mechanisms. The methods and products of the disclosure are not limited to any one mechanism. The method may be performed in vitro, e.g., for studying gene function, ex vivo or in vivo, e.g. for therapeutic purposes.

The therapeutics can also be provided as pro-drugs. The term "prodrug" refers to a therapeutic that can undergo biotransformation (e.g., either spontaneous or enzymatic) within the subject to release, or to convert (e.g., enzymatically, mechanically, electromagnetically, etc.) an active or more active form of the therapeutic after administration. Prodrugs can be used to overcome issues associated with stability, toxicity, lack of specificity, or limited bioavailability and often offer advantages related to solubility, tissue compatibility, and/or delayed release (See e.g., Bundgard, Design of Prodrugs, pp. 7-9, 21-24, Elsevier, Amsterdam (1985); and Silverman, The Organic Chemistry of Drug Design and Drag Action, pp. 352-401, Academic Press, San Diego, Calif. (1992) both incorporated by reference for their teachings regarding the same).

For example, a subject can be provided an miRNA or artificial miRNA molecule corresponding to a particular miRNA by administering a nucleic acid molecule that functions as the corresponding miRNA once inside the cell. In these embodiments, the nucleic acid molecule is processed into the intended miRNA or artificial miRNA once it has access to the cell's miRNA processing machinery. In particular embodiments, the processing is post-translational modifications, such as, without limitation, adenosine to inosine editing.

Exemplary protein prodrugs can comprise an active protein and a chemical masking group (e.g., a group that reversibly suppresses the activity of the protein). Some preferred prodrugs are variations or derivatives of proteins that have sequences that are cleavable under metabolic conditions. Exemplary prodrugs become active or more active in vivo or in vitro when they undergo a biochemical transformation (e.g., phosphorylation, hydrogenation, dehydrogenation, glycosylation, etc.).

When the therapeutics are provided as part of a genetic therapy, "in vivo expression elements" are any regulatory nucleotide sequence, such as a promoter sequences or promoter-enhancer combinations, which facilitate the efficient expression of the therapeutic following administration to a subject. The in vivo expression element may, for example, be a mammalian or viral promoter, such as a constitutive or inducible promoter or a tissue specific promoter, examples of which are well known to one of ordinary skill in the art. Constitutive mammalian promoters include polymerase promoters as well as the promoters for the following genes: hypoxanthine phosphoribosyl transferase (HPTR), adenosine deaminase, pyruvate kinase, and beta-actin. Exemplary viral promoters which function constitutively in eukaryotic cells include promoters from the simian virus, papilloma virus, adenovirus, human immunodeficiency virus (HIV), Rous sarcoma virus, cytomegalovirus, the long terminal repeats (LTR) of moloney leukemia virus and other retroviruses, and the thymidine kinase promoter of herpes simplex virus. Other constitutive promoters are known to those of ordinary skill in the art. Inducible promoters are expressed in the presence of an inducing agent and include metal-inducible promoters and steroid-regulated promoters. For example, the metallothionein promoters is induced to promote transcription in the presence of certain metal ion. Other inducible promoters are known to those of ordinary skill in the art.

Examples of tissue-specific promoters include: for muscle and cardiac tissue, creatine kinase and alpha-actin promoter; for B cells, immunoglobulin heavy or light chain promoters; for liver, HMG-COA reductase promoter, sterol regulatory element 1, phosphoenol pyruvate carboxy kinase (PEPCK) promoter, human C-reactive protein (CRP) promoter, human glucokinase promoter, cholesterol 7-alpha hydroylase (CYP- 7) promoter, beta-galactosidase alpha-2,6 sialyltransferase promoter, insulin-like growth factor binding protein (IGFBP-1) promoter, aldolase B promoter, human transferrin promoter, and collagen type I promoter; for prostate, prostatic acid phosphatase (PAP) promoter, prostatic secretory protein of 94 (PSP 94) promoter, prostate specific antigen complex promoter, and human glandular kallikrein gene promoter (hgt-1); for gastric tissue, human H+/K+-ATPase alpha subunit promoter; for pancreas, pancreatitis associated protein promoter (PAP), elastase 1 transcriptional enhancer, pancreas specific amylase, elastase enhancer promoter, and pancreatic cholesterol esterase gene promoter; for endometrium, uteroglobin promoter; for adrenal cells, cholesterol side-chain cleavage (SCC) promoter; for nervous system, gamma-gamma enolase (neuron-specific enolase, NSE) promoter; for brain, neurofilament heavy chain (NF-H) promoter; for lymphocytes, human CGL-1/granzyme B promoter, terminal deoxy transferase (TdT), lambda 5, VpreB, Ick (lymphocyte specific tyrosine protein kinase p561ck) promoter, the human CD2 promoter and its 3' transcriptional enhancer, and the human NK and T cell specific activation (NKG5) promoter; for colon, pp60c-src tyrosine kinase promoter, organ-specific neoantigens (OSNs) promoter, and colon specific antigen-P promoter; for breast cells, human alpha-lactalbumin promoter; and for lung, cystic fibrosis transmembrane conductance regulator (CFTR) gene promoter. Other elements aiding specificity of expression in a tissue of interest can include secretion leader sequences, enhancers, nuclear localization signals, endosmolytic peptides, etc. In particular embodiments, these elements are derived from the tissue of interest to aid specificity.

VI. Formulations & Routes of Administration

Pharmaceutical compositions disclosed herein generally include pharmaceutically acceptable carriers which refer to compositions that do not produce significantly adverse, allergic or other untoward reactions that outweigh the therapeutic benefit of administration. Exemplary pharmaceutically acceptable carriers and formulations are disclosed in Remington's Pharmaceutical Sciences, 18th Ed. Mack Printing Company, 1990, which is incorporated by reference herein for its teachings regarding the same. Moreover, for human administration, all formulations will meet sterility, pyrogenicity, general safety and purity standards as required by U.S. FDA Office of Biological Standards and/or other relevant foreign regulatory agencies.

Generally used pharmaceutically acceptable carriers include any and all solvents, dispersion media, coatings, surfactants, antioxidants, preservatives (e.g., antioxidants, antibacterial agents, antifungal agents including parabens (e.g., methylparabens, propylparabens), chlorobutanol, phenol, sorbic acid, thimerosal or combinations thereof), isotonic agents, absorption delaying agents, salts, preservatives, stabilizers, gels, binders, disintegration agents, and lubricants. Except insofar as any conventional pharmaceutically acceptable carrier is incompatible with the particular therapeutic disclosed herein, its use in the pharmaceutical compositions is encompassed.

Formulations can be generated based on the chosen route of administration. Formulations can be administered by injection, inhalation, infusion, perfusion, lavage or ingestion. Routes of administration can include intravenous, intradermal, intraarterial, intraperitoneal, intralesional, intracranial, intraarticular, intraprostatic, intrapleural, intratracheal, intranasal, intravitreal, intravaginal, intrarectal, topically, intratumoral, intramuscular, intravesicular, intrapericardial, intraumbilical, intraocularal, subcutaneous, subconjunctival and/or mucosal.

For injection, formulations can be made as aqueous solutions, such as in buffers such as Hanks' solution, Ringer's solution, or physiological saline. The solutions can contain formulatory agents such as suspending, stabilizing and/or dispersing agents. Alternatively, the formulation can be in lyophilized and/or powder form for constitution with a suitable vehicle, e.g., sterile pyrogen-free water, before use.

For topical administration formulations can be made as solutions, gels, ointments, creams, suspensions, etc. as are well-known in the art.

For nasal administration, formulations can be made as aqueous solutions designed to be administered to the nasal passages in drops or sprays. Nasal solutions are prepared so that they are similar in many respects to nasal secretions, so that normal ciliary action is maintained. Thus, in preferred embodiments aqueous nasal solutions usually are isotonic or slightly buffered to maintain a pH of 5.5 to 6.5.

For transmucosal administration, formulations can be made with penetrants appropriate to the barrier to be permeated. Such penetrants are generally known in the art.

For oral administration, the formulations can be made as tablets, pills, dragees, capsules, liquids, gels, syrups, slurries, suspensions and the like. For oral solid formulations such as, for example, powders, capsules and tablets, suitable excipients include binders (gum tragacanth, acacia, cornstarch, gelatin), fillers such as sugars, e.g. lactose, sucrose, mannitol and sorbitol; dicalcium phosphate, starch, magnesium stearate, sodium saccharine, cellulose, magnesium carbonate; cellulose preparations such as maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP); granulating agents; and binding agents. If desired, disintegrating agents can be added, such as corn starch, potato starch, alginic acid, cross-linked polyvinylpyrrolidone, agar, or alginic acid or a salt thereof such as sodium alginate. If desired, solid dosage forms can be sugar-coated or enteric-coated using standard techniques. Flavoring agents, such as peppermint, oil of wintergreen, cherry flavoring, orange flavoring, etc. can also be used.

For administration by inhalation, formulations can be made as aerosol sprays from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of gelatin for use in an inhaler or insufflator may be formulated containing a powder mix of the therapeutic and a suitable powder base such as lactose or starch.

Therapeutics can also be formulated as depot preparations. Such long acting formulations may be administered by implantation (for example subcutaneously or intramuscularly) or by intramuscular injection. Thus, for example, the therapeutic can be formulated with suitable polymeric or hydrophobic materials (for example as an emulsion in an acceptable oil) or ion exchange resins, or as sparingly soluble derivatives, for example, as a sparingly soluble salts.

Additionally, therapeutics can be delivered using sustained-release systems, such as semipermeable matrices of solid polymers containing the therapeutic. Various sustained-release materials have been established and are well known by those skilled in the art. Sustained-release capsules may, depending on their chemical nature, release the therapeutic for a few weeks up to over 100 days.

EXAMPLES

Materials and Methods

Counting Method. Position 1 was assigned to the first nucleotide pair after the Drosha cutting site. The nucleotides that would form the single stranded overhang after Drosha processing were assigned negative positions (−1, −2 etc.) and if the cutting site was known for only one strand the overhang was assumed to be 2 nt. Positions were then assigned for each nucleotide pair in ascending order moving towards the Dicer cleavage site. The average hairpin contains several mismatches, which occasionally contain more nucleotides in one strand than in the other. Whenever such a length discrepancy occurred, the shorter strand was used to assign the mismatch position, using the later position whenever an asymmetric mismatch was located between two positions. Each position where the nucleotides were bound to each other was assigned the score 0, while positions with at least one nucleotide mismatched were given the score 1.

Genomic location. Data from miRBase was used to determine whether each miRNA was intronic or intergenic. The fold change values in the two groups are visualized in FIG. 2. Significance was calculated using a t-test. Information regarding whether each miRNA was intronic or intergenic was retrieved from miRBase and fold change distribution was analyzed for each of the two groups and differences in distribution was calculated using a t-test.

miRNA machinery and structure in neuronal differentiation. H1 cells were differentiated into neurons using 90% confluent cells on Matrigel. The differentiation was performed using a modified version of the dual SMAD inhibition protocol (Chambers et al. 2009), using the TGF-β inhibitor SB432542, ALK inhibitor LDN193189, and cyclopamine in CDM Basal media, which was changed daily for 12 days. At time points 0, 6, and 12 days starting from the first addition of inhibitors, cells were harvested. mRNA and miRNA were purified using the RNeasy Plus Mini Kit, and the miRNeasy Mini Kit, respectively, according to manufacturer instructions (Qiagen). Expression levels were measured using RNAseq (Expression Analysis Inc) and single-color miRNA microarrays (LC Sciences) respectively. RNAseq expression data were then count- and length-normalized to transcripts per million (TPM) after exclusion of mitochondrial genes, and miRNA expression data were Lowess normalized for cross-chip comparisons.

H1 Cell Culture.

H1 human embryonic stem cell lines were cultured on a feeder layer (MEFs) in Dulbecco's modified Eagle's medium (DMEM)/Ham's F-12 medium containing GlutaMax supplemented with 20% serum replacer (SR), 1 mM sodium pyruvate, 0.1 mM non-essential amino acids, 50 U/ml penicillin, 50 ug/ml streptomycin, 0.1 mM β-mercapto-ethanol (Sigma-Aldrich, St. Louis), and 2 ng/ml basic fibroblast growth factor (Qi et al 2009). Knockdowns of Drosha and Dicer were generated by infection with lentiviral vectors containing shRNA constructs against Drosha and Dicer respectively. Control cells were infected with control viruses. After passaging the next day, infected cells were treated with blasticidin (0.5 ug/ul) for selection until discrete clusters of cells appeared. If cells showed less stability with respect to Drosha knockdown, cells were repeatedly selected with antibiotics (Qi et al. 2009).

Generation of HeLa line with Drosha knockdown. HeLa cells were transduced with a pL6-Tet lentiviral vector containing shRNA against Drosha (Qi et al. 2009) (Titer 1.79E+08, MOI of 1:10; 10 μg/ml blasticidin selection for 4 days). Generation of the control cells was done with a pLKO.1 control lentivirus, (MOI 1:10; 10 μg/ml puromycin selection for 4 days).

Drosha qPCR analysis. Drosha and DGCR8 levels were measured in Drosha KD and Control HeLa cells using the SYBR-GREEN Q-PCR kit. Drosha Ct values were normalized to GAPDH (ΔCt: Drosha-GAPDH). The ΔΔCt values were calculated by subtracting the Drosha ΔCt values in the Control cells from those values in the KD cells. Fold change was calculated using the $(2^{(-\Delta\Delta Ct)})$ method.

Total RNA extraction and quantitative RT-PCR analysis. Brain and liver tissues were dissected from WT mice (n=3). Tissues were homogenized using mortar and pestle in a liquid nitrogen bath. RNA was extracted from cells adherent on plates or from tissue homogenate using Trizol reagent (Invitrogen) and cDNA was synthesized with the Omniscript RT kit (Qiagen). Beta-actin or UBC was used as endogenous control for normalization. Quantitative PCR reactions were performed in triplicate using the SyberGreen (Applied Biosystems) with the 7300 real time PCR system (Applied Biosystems). Primers used in our study are listed in the following Table 4.

TABLE 4 qPCR Primer Sequences.

| Primer | Sequence |
|---|---|
| Drosha | SS-AGGAGTACGCCATAACCAACG |
|  | AS-CAATCGTGGAAAGAAGCAGACA |
| β-actin | F-TCCCTGGAGAAGAGCTACG |
|  | R-GTAGTTTCGTGGATGCCACA |
| Gapdh | SS-TGATGACATCAAGAAGCTGGTGAAG |
|  | AS-TCCTTGGAGGCCATGTGGGCCAT |
| Bleomycin | F-AGCTGTACGCCGAGTGGTC |
|  | R-CGTGTCAGTCCTGCTCCTC |
| Ubc | F-ATTTGGGTCGCGGTTCTTG |
|  | R-TGCCTTGACATTCTCGATGGT |

Normalized Drosha levels in the brain were compared to those in the liver and the fold change was calculated using the $2^{(-\Delta\Delta Ct)}$ methods.

qPCR of miRNAs was conducted using TaqMan® miRNA assays (Applied Biosystems). miRNA expression was measured in both DroshaKD and Control HeLa cells. Raw Ct values for miRNAs were first normalized to RNU66 (endogenous snoRNA, internal control). Bleomycin values were normalized to GAPDH. To normalize to transfection efficiency, the normalized miRNA values were re-normalized to the normalized Bleomycin values (normalized miRNA ΔCt−normalized Bleomycin ΔCt). This new normalized value from control cells was subtracted from the corresponding value in the knockdown cells to generate the ΔΔCt values. Fold change with respect to the control cells was calculated using the $2^{(-\Delta\Delta Ct)}$ method.

Protein extraction and Western blot. With the exception of mouse tissues, protein extraction and Western blot analysis followed procedures that were described previously (Zhou et al., 2011). Briefly, cells were washed with Dulbecco's PBS (Sigma Aldrich, St. Louis, Mo.) and directly lysed on culture dish using M-PER Mammalian Protein Extraction Reagent (Thermo Scientific, Rockford, Ill.; 0.5 ml per 35 mm plate) and protease inhibitor cocktail (Complete Mini, Roche Applied Science, Germany). 20 μg of protein extracts were loaded, separated by 4-20% SDS-PAGE using Mini-PRO- TEAN TGX Precast Gels (Bio-Rad, Hercules, Calif.), and transferred to polyvinylidene difluoride transfer membranes (Thermo Scientific). Membranes were blocked with 5% non-fat dry milk for at least 60 minutes at room temperature, and incubated overnight at 4° C. with primary antibody. Blots were incubated for one hour with horseradish peroxidase-conjugated Blotting Grade Affinity Purified secondary antibodies (Bio-Rad) and were visualized by enhanced chemiluminescence (Millipore Corp, Billerica, Mass.). Protein expression levels in the gel were quantified by densitometry implemented in Image-J (National Institutes of Health, Bethesda http://rsb.info.nih.gov/ij/, 1997-2013). Antibodies used in this study are: rabbit anti-Drosha antibody (Cell Signaling Technology, Beverly, Mass.) diluted at 1:1000, mouse anti-β-actin antibody (Santa Cruz Biotechnology, Santa Cruz, Calif.) diluted at 1:5000, goat anti-rabbit antibody (Bio-Rad Laboratories, Hercules, Calif.) diluted at 1:10000 and goat anti-mouse antibody (Bio-Rad Laboratories, Hercules, Calif.). For mouse tissues, the protocol above was followed for protein extraction, gel loading, and the quantification of Drosha expression. As a control, either Western using actin Ab or Coomassie Brilliant Blue R (Sigma Aldrich) staining was used. Entire-cell protein expression was quantified using Image-J.

Transfections. The mutations were performed on the passenger strand, leaving the mature strand unchanged in order to be able to detect both the mutated and non-mutated miRNAs using the same TaqMan® assay. The pri-miRNA inserts were amplified from genomic DNA by PCR, including the hairpin and ~200 nt flanks on each side. The inserts were ligated into a modified pcDNA3.1+ plasmid with the neomycin selection marker replaced with a bleomycin resistance gene. Mutated versions of the constructs, with altered mismatches in the 9-12 region, were ordered from Genscript. The miRNA constructs were transiently transfected into HeLa cells using Lipofectamine2000. RNA was extracted after 48 hours using Trizol.

Analysis of Drosha and miRNA expression in mouse tissues. For GDS3052 and GDS3142: These are two microarray analyses done in mouse using an Affymetrix Mouse Genome 430 2.0 chip. Drosha expression values were extracted from the datasets and were normalized to a gene that in both studies showed minimal variation between tissues; Eef2 (eukaryotic translation elongation factor 2). Drosha expression was represented as percent of Eef2 in the tissues.

For Takada et al. 2006: The miRNAs expressed in each tissue were first sorted according to number of clones (highest number of clones being highest expression and lowest number of clones being lowest expression). The miRNAs were then divided into groups based on the number of mismatches in the 5, 9-12 region (X-axis) and within each group the average expression level (Y-axis) was calculated by geometric mean.

In vitro processing of miRNAs. Plasmids for wild type (wt) and modified versions of mir-137 and mir-200b were linearized, gel purified and in vitro transcribed using the Riboprobe (Promega) protocol and labeled with $\alpha^{32}$P-CTP. Transcripts were purified using the RNAeasy mini kit (Qiagen) and then allowed to fold by addition of KAc, heating to 95° C. for 5 min and then kept on ice till the processing reaction. Processing was performed by mixing folded pri-microRNA transcripts with 8 μg 293T cell nuclear extract (Protein One) for 10, 30 and 90 minutes at 37° C. followed by trizol extraction and run on a 10% polyacrylamide-urea gel for 4 hours at 650V. Gel exposures were quantified using ImageJ64 software where intensities of bands corresponding to pre-miRNAs were normalized to regions containing pri-miRNA transcripts.

Statistical analysis. Throughout the experiments, P values for expression levels were calculated using Student's t-test. *, $P<0.05$; and **, $P<0.01$. Bars show Standard error of the mean (SEM) for at least 3 separate experiments. P-values for differences in mismatch trends were calculated in R using a chi-square test with Yate's continuity correction.

Results

Differences in change of miRNA expression due to Drosha knockdown in hESC (H1) correlate with differences in predicted pri-miRNA secondary structures. Previous research in the laboratory used H1 human embryonic stem cells with Drosha KD to study the response to a general decrease of miRNAs in stem cells (Bar et al. 2008; Qi et al. 2009; Stadler et al. 2010). qPCR of 220 microRNAs in Drosha KD hESCs showed a general decrease of miRNA expression. However, a group of miRNAs was still processed efficiently, despite the 3-fold reduction of Drosha expression (FIG. 1). It seems logical that mirtrons (which bypass Drosha processing) would be unaffected by Drosha KD, however, few mirtrons are known (Berezikov et al. 2007) and none of the known mirtrons are in the 220 miRNAs assayed by qPCR. Mirtrons are generally located within small introns, but no statistically significant correlation could be verified between genomic location and fold change of miRNA expression (p=0.27); the mean fold change was 2.8 for intergenic miRNAs, and 2.4 for the intronic miRNAs (FIG. 2).

Figure 3A:
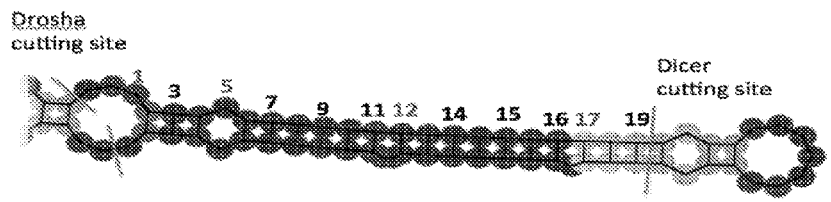
FIG. 3. Counting of mismatches in miRNAs in H1 cells with DroshaKD and control cells. Positions regarded as mismatched are marked by numerals in light grey (FIG. 3A). Mismatches summed for positions counted from the Drosha cutting site for a set of 202 miRNAs split in two equal groups based on fold change in the Drosha knockdown (FIG. 3B). P-values were calculated using Pearson's Chi-squared test with Yates' continuity correction, giving log p-values <−2 for positions 5, 10, 11 and 12 for the full data set split in half (dark grey) and for the quartiles at the extreme ends with sample size extrapolated to that of the full data set (FIG. 3C).

Given that bulges in the stem of RNA hairpins seem to prevent processing by the miRNA pathway in general, and that others have shown Drosha to differentially process miRNAs based on structural features (Han et al. 2006; Ritchie et al. 2007; Feng et al. 2011), it seems logical that differences in the number of mismatches in miRNA hairpins would alter their interaction with the Microprocessor, and could explain the variation of fold change in response to Drosha KD. In order to compare the three-dimensional shape of the pri-miRNAs in the described dataset, a novel method of assigning position within the miRNA hairpin was developed in order to give a better representation of the mismatch locations relative to each other and the Drosha cutting site in three dimensional space (FIG. 3A). Position assignment and mismatch counting was performed by defining the location of each mismatch in terms of distance from the Drosha cutting site using predicted secondary structure, counting asymmetric mismatches as the length of the shorter strand; this is different from previously described methods to calculate mismatch positions in pri-miRNAs, where asymmetry was not taken into account (Han et al. 2006).

Figure 3B:
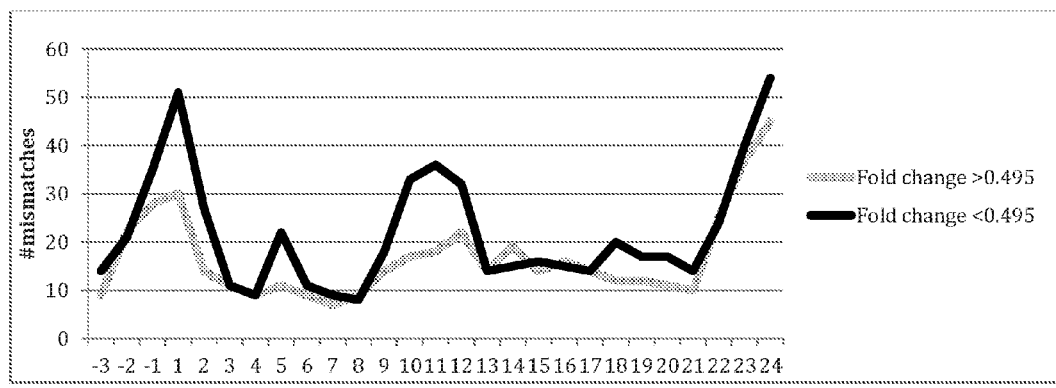
Figure 3C:
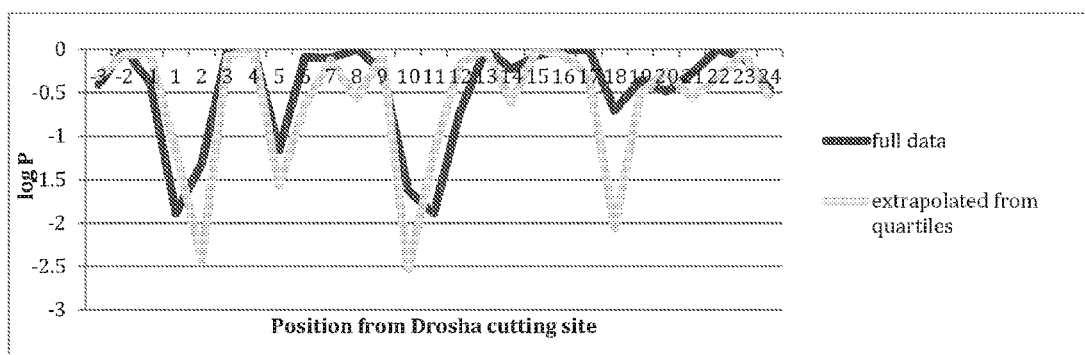
Figure 10:
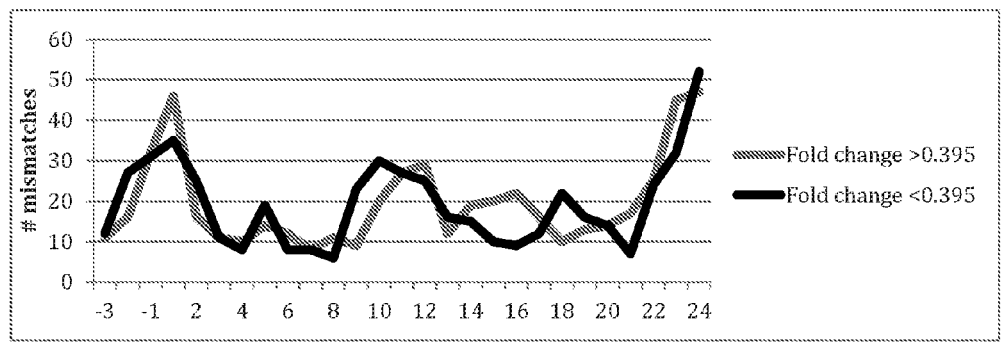
FIG. 10. Counting of mismatches in miRNAs in H1 cells with DicerKD and control cells. Mismatches summed for positions counted from the Drosha cutting site for a set of 202 miRNAs split in two equal groups based on fold change (median=0.395) in the Dicer knockdown.

The secondary structures for the 220 miRNAs from the H1 dataset were calculated using the ViennaRNA package (Hofacker et al. 1994), and exact locations of cutting sites were found through miRBase. The dataset contained 220 miRNAs, and 202 were selected by sorting out any miRNAs with ambiguous secondary structure predictions. The dataset was split in half based on fold change (FIG. 1, arrow), and the sums of mismatches at each nucleotide position were compared between the two groups. The summation revealed that miRNAs with a high fold change when Drosha levels were reduced had more mismatches in position(s) 5 and 10-12 than miRNAs with low fold change, and that these differences were statistically significant (FIG. 3B, C). A knockdown of Dicer did not result in the same trend (FIG. 10) In addition p-values were calculated for the quartiles at the extreme ends of the DroshaKD dataset, with a sample size extrapolated to that of the total data set (FIG. 3C). For subsequent experiments and analysis position 9 was also included because it follows the same trend as positions 10-12. This takes into account any lack of specificity in the method of assigning positions.

Correlation of Drosha expression and miRNA secondary structure profile in mature tissues. Having shown that pri-miRNA processing by Drosha is affected by the pri-miRNA secondary structure in cell culture whether this mechanism is used in vivo as a mechanism to selectively regulate groups of miRNAs based on secondary structure was also investigated. Because Drosha expression alters the expression of miRNAs with bulges in the central region more than miRNAs without (FIG. 3), and because of the crucial role of miRNAs for cellular biology, whether or not Drosha expression levels vary across cell type or according to developmental stage in mammals was examined. To find naturally occurring examples of Drosha variation, the Gene Expression Omnibus (GEO) was used to find microarray data of relevant gene expression in mature and differentiating mouse tissues.

Figure 4:
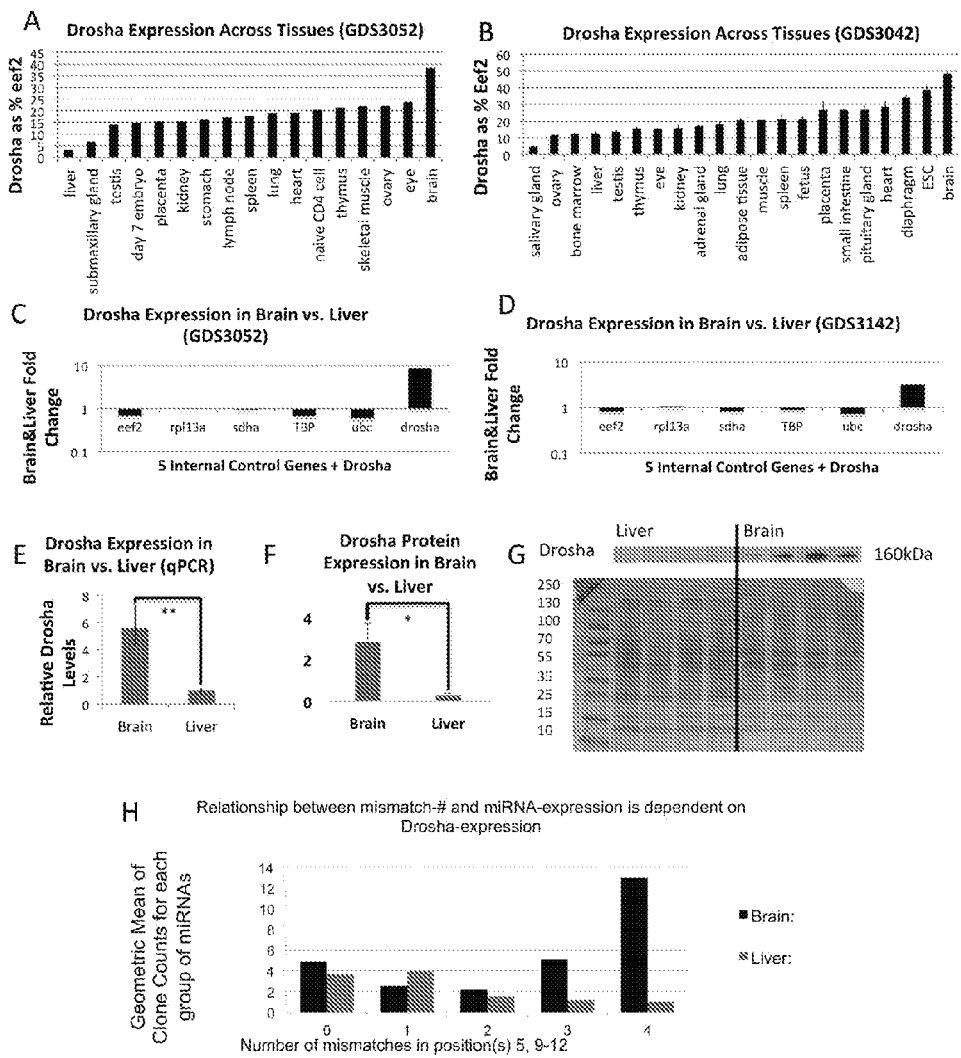
FIG. 4. Differential expression of Drosha in mouse tissues. Expression levels in Drosha in mouse tissues, normalized to EEF2; GEO(GDS3052) (A), GEO(GDS3142) (B). Fold change of Drosha expression in liver, compared to the average expression of EEF2, RPL13A, SDHA, TBO and UBC; GDS3052 (C), GDS3142 (D). qPCR analysis of Drosha mRNA levels in mouse brain and liver (E), Quantification of Drosha protein levels show 9.6 fold increase in brain compared to liver tissue (p<0.05) (F), Western blot of Drosha protein in mouse brain and liver normalized to total protein (Coomassie Blue) (G), Geometric mean of clone counts of miRNAs with 1, 2, 3, 4 and 5 mismatches in the positions 5, 9-12 nucleotides from the Drosha cutting site in mouse liver and brain (Takada et al. 2006) (H).

From the GEO expression datasets GDS3052 and -3142, expression data for Drosha and common housekeeping genes in multiple mouse tissues was extracted and analyzed. In both datasets the expression of Drosha is dramatically lower in liver and submaxillary/salivary gland (4-10 fold) than in brain tissues when normalized to EEF2 (FIG. 4A-B). To test whether the difference in Drosha expression was dependent on the housekeeping gene used for normalization, the fold change of expression between liver and brain tissues for five housekeeping genes; EEF2, RPL13A, SDHA, TBP, and UBC was analyzed. The data revealed that the expression change for Drosha is greater than variation among known housekeeping genes (FIG. 4C-D), showing that Drosha is differentially expressed regardless of the housekeeping gene used for normalization.

Figure 11:
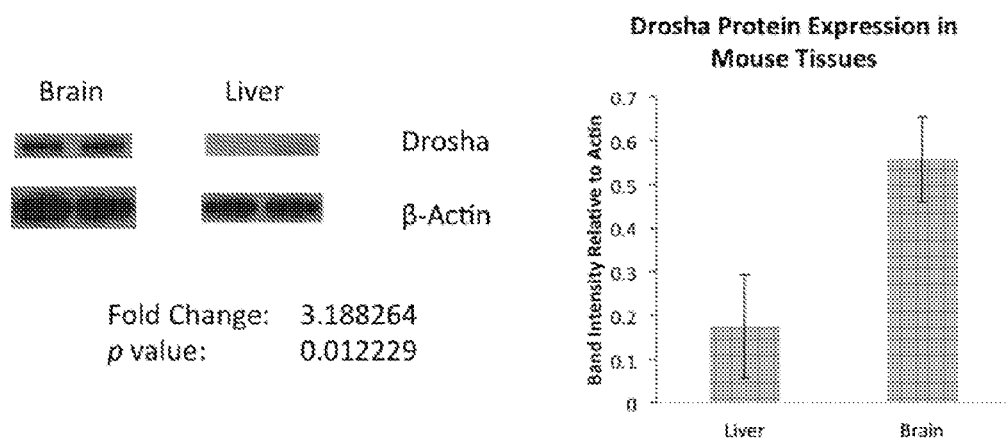
FIG. 11. Drosha protein expression levels in mouse brain and liver. Protein levels of Drosha and β-actin measured by western blots (A). Quantification of Protein levels using triplicates extrapolated from different gels. Fold change=3.2, p<0.05 (B).

The differential expression of Drosha in mouse brain and liver by qPCR was validated, and normalized to UBC, verifying that Drosha expression was 5.6 fold higher in the brain than in the liver (FIG. 4E; n=3, p<0.01). Furthermore, Western blotting revealed 9.6 or 3.2 fold higher Drosha protein expression in brain than in liver when normalized to total protein or to β-actin expression, respectively (Coomassie Blue staining or to β-actin Western; FIG. 4F,G; FIG. 11).

Figure 12:
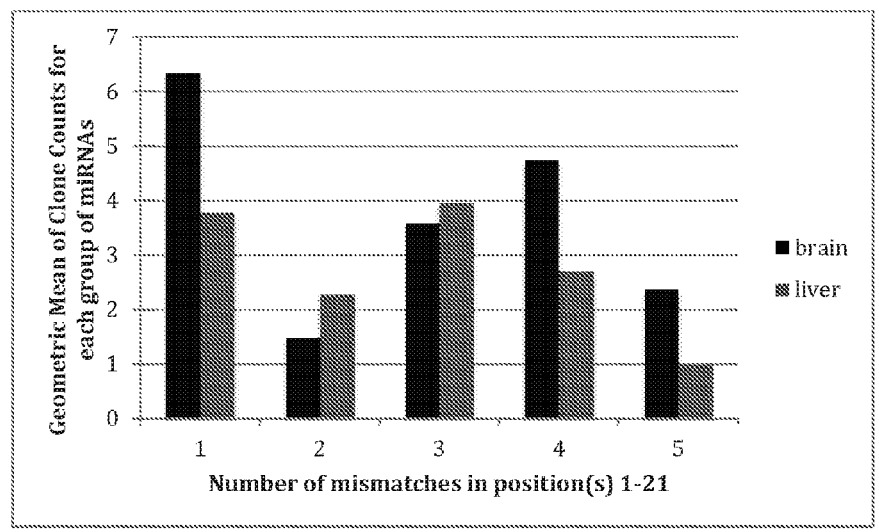
FIG. 12. Control mismatch counts for mouse brain and liver. Average expression of miRNAs with different numbers of mismatches in the 1-21 region in mouse liver and brain (Takada et al. 2006).

Having validated that Drosha levels are higher in brain than in liver, whether miRNA expression varies according to the number of mismatches in the 9-12 nt region of the miRNAs in the two tissues was examined. miRNA expression data from mouse brain and liver (Takada et al. 2006) was analyzed. It was found that miRNAs with mismatches in positions 5 and 9-12 are enriched in brain but not in liver and that the difference was larger the more mismatches present (FIG. 4H), supporting the hypothesis that miRNAs with central mismatches are not processed efficiently when Drosha is limiting. This trend for miRNA expression did not correlate with mismatches in the other positions (FIG. 12).

Figure 5:
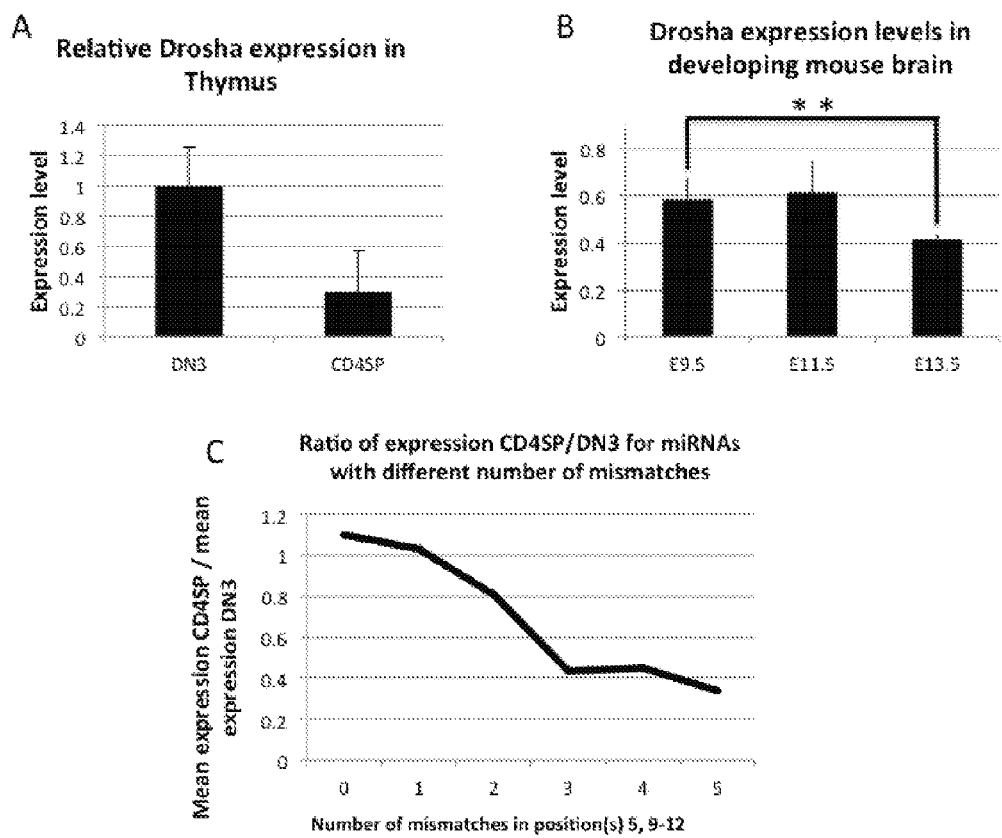
FIG. 5. Drosha levels and miRNA profiles during T-cell differentiation. Drosha levels in T-cells measured by qPCR, normalized to β-actin (Chong et al. 2010) (A). Drosha levels in developing mouse brain (GDS3442), normalized to EEF2 (B). Ratio (CD4SP/DN3) of average expression for each miRNA group based on number of mismatches in the 5, 9-12 region (C).

Coordination of Drosha and miRNA expression by microRNA secondary structure during T-cell development and neuronal differentiation. Because Drosha levels vary between mature tissue types and expression levels of miR-NAs with mismatches in the central region are high relative to rigid miRNAs when Drosha levels are high, whether this mechanism is used to dynamically alter the miRNA expression profiles during cell development was tested. In order to establish this relationship, Drosha expression levels during T-cell differentiation was determined and a 3-fold decrease in Drosha expression from double-negative T-cells (DN3) to CD4+ cells (Chong et al. 2010) (FIG. 5A) was found. In neuronal lineage, Drosha and Eef2 expression were compared during the proliferation of mouse neural progenitors (GDS3442). A significant decrease (p<0.01) in Drosha expression as the cells proliferate and mature in embryonic mouse brains was observed (FIG. 5B).

Figure 13:
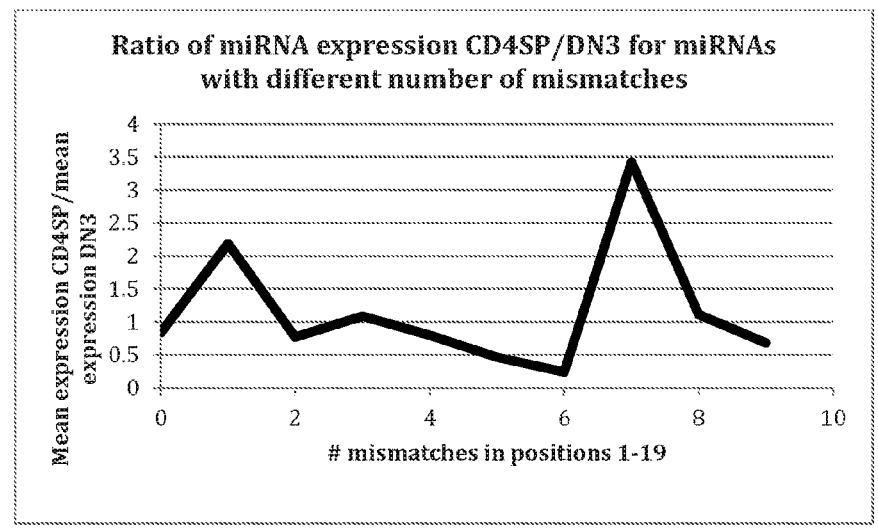
FIG. 13. Control mismatch ratios in T-cells. Ratio (CD4SP/DN3) of average expression for each miRNA group based on number of mismatches in the 5, 9-12 region.

Whether the miRNA groups correlate with the Drosha levels was tested. It was found that the lower Drosha expression in CD4+ compared to DN3 cells correlates with lower expression of miRNAs with 5 mismatches in the region 5, 9-12 nt from the Drosha cutting site and the ratio of expression between DN3 and CD4+ for miRNAs grouped by the number of mismatches in positions 5 and 9-12 shows that the difference in Drosha expression between DN3 and CD4+ cells correlates with a decrease in miRNA expression based on number of mismatches (FIG. 5C). In DN3 cells Drosha levels are relatively high, and mismatched miRNAs are highly expressed; in CD4+ cells Drosha levels are low, and predominantly rigid miRNAs are produced. This agrees with previous results that when Drosha levels are low the levels of mature miRNAs generated from mismatched hairpins go down disproportionately compared to rigid miRNAs (FIG. 3B-C, 4C-D). Mismatch counting of the complete hairpin, to control for the difference being local to the 5, 9-12 region, did not result in a similar trend (FIG. 13).

Figure 6:
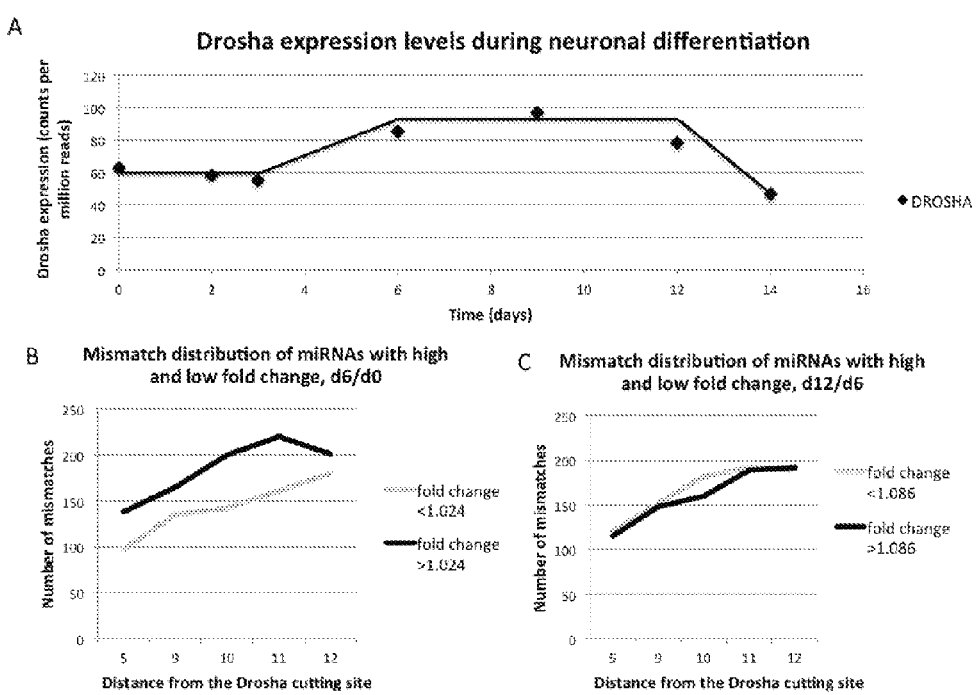
FIG. 6. Changes in gene expression levels during neuronal differentiation. Drosha expression in neuronal differentiation of H1 hESC into Pax6+ neural cells (RNAseq) (A). Number of mismatches in miRNAs with high and low fold change through days 0-6 (multiArray) (B). Number of mismatches in miRNAs with high and low fold change through days 6-12 (multiArray) (FIG. 3C).
Figure 14:
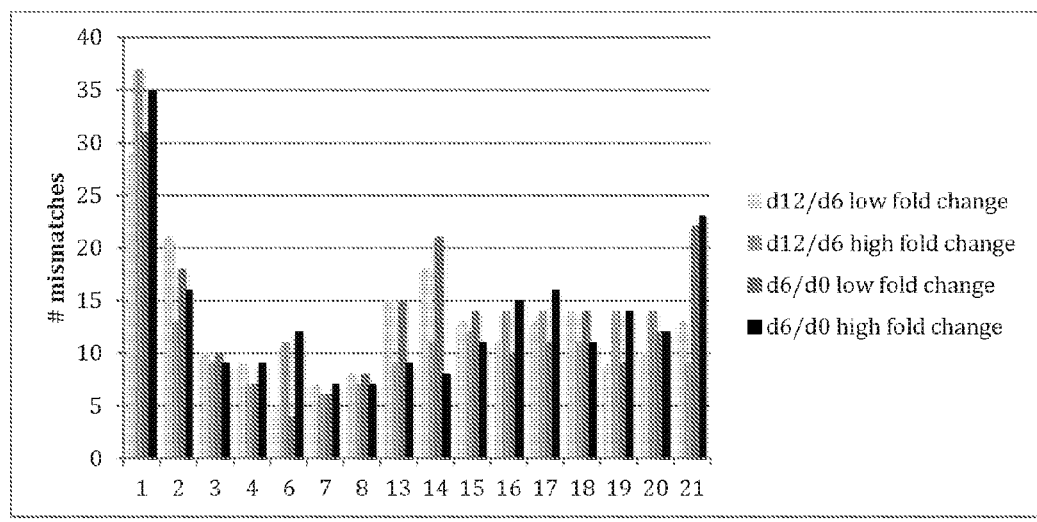
FIG. 14. Control mismatch counts during neuronal differentiation. Number of mismatches outside the 5, 9-12 region in miRNAs with high and low fold change (multiArray) in neuronal differentiation through days 0-6 and 6-12.

Drosha levels in hESC derived neuronal differentiation process were also determined. RNAseq data from early neuronal differentiation of H1 hESC shows an increase in Drosha, with a greater change occurring over day 0 to day 6 than day 6 to day 12 (FIG. 6A). Canonical and non-canonical components of the miRNA biogenesis pathway have a significantly greater change in expression between days 0 and 6 than between days 6 and 12 of the neural differentiation protocol. miRNA microarray data from the same period, day 0 to day 6, when Drosha levels increase, shows that the miRNAs with positive fold-change have significantly more mismatches in the region(s) 5, 9-12 than miRNAs with negative fold change (FIG. 6B). Between days 6 and 12, when changes in Drosha expression are significantly lower, no significant difference in number of mismatches can be found between miRNAs grouped by fold-change (FIG. 6C). This shows that when Drosha levels increase in early neuronal differentiation the expression of miRNAs generated from hairpins with mismatches in the 5, 9-12 region go up relative to more rigid hairpins, and when Drosha levels stabilize mismatched miRNAs no longer behave differently from rigid ones (FIG. 6B-C) Whether increasing or decreasing during cell development, changes in Drosha levels affect groups of miRNAs based on their secondary structure. To control for the difference being local to the 5, 9-12 region, mismatches were counted in the remaining positions for a subset of 166 miRNAs, where no similar trend was observed (FIG. 14).

Figure 7A:
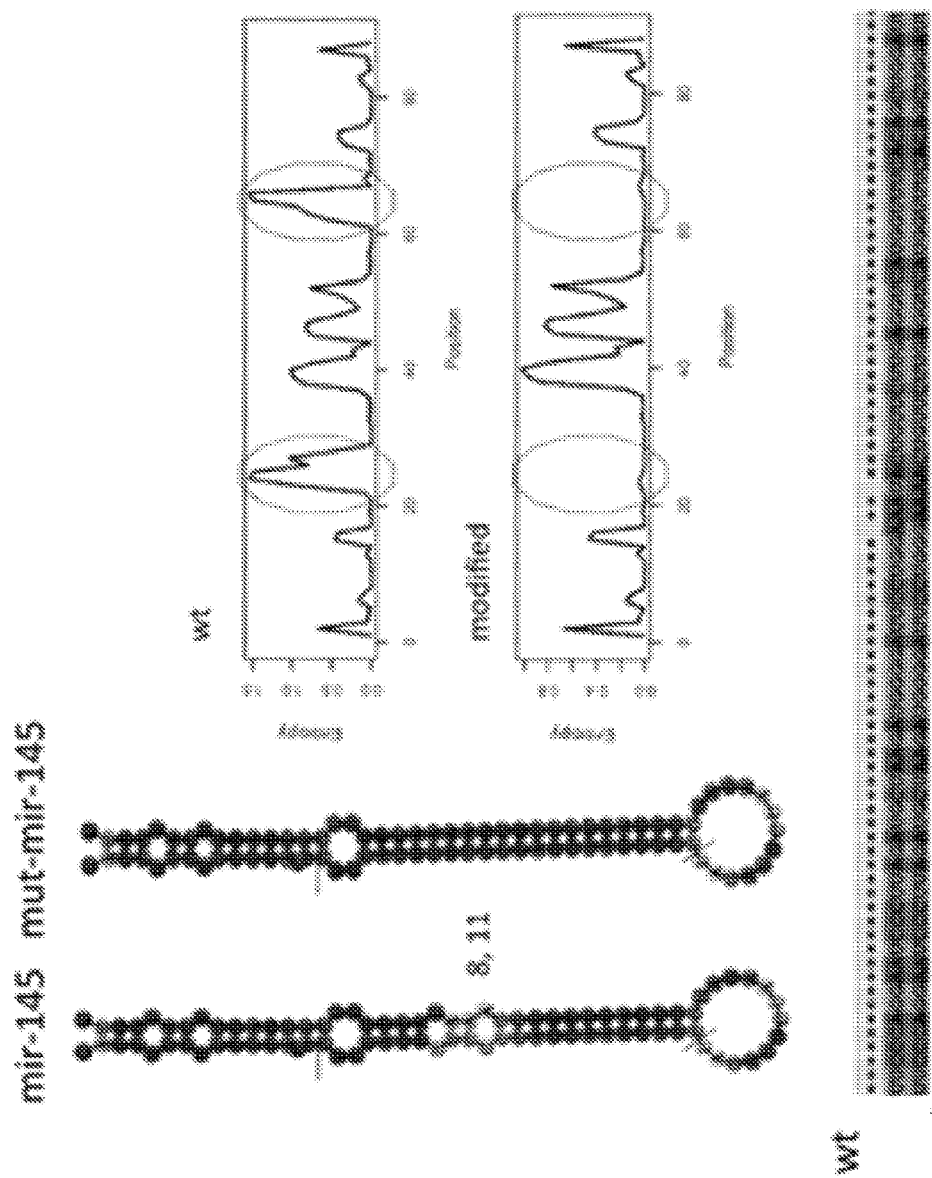
FIG. 7. Predicted structures of wild-type and modified hairpins of hsa-mir-145, (FIG. 7A), -137 (FIG. 7B), -9-1 (FIG. 7D) and 200b (FIG. 7C), demonstrating canonical "mismatched" and "rigid" miRNA hairpins. Entropy curves of the nucleotide sequence, starting at the 5' end, indicate stability changes being local to the changed regions.
Figure 7B:
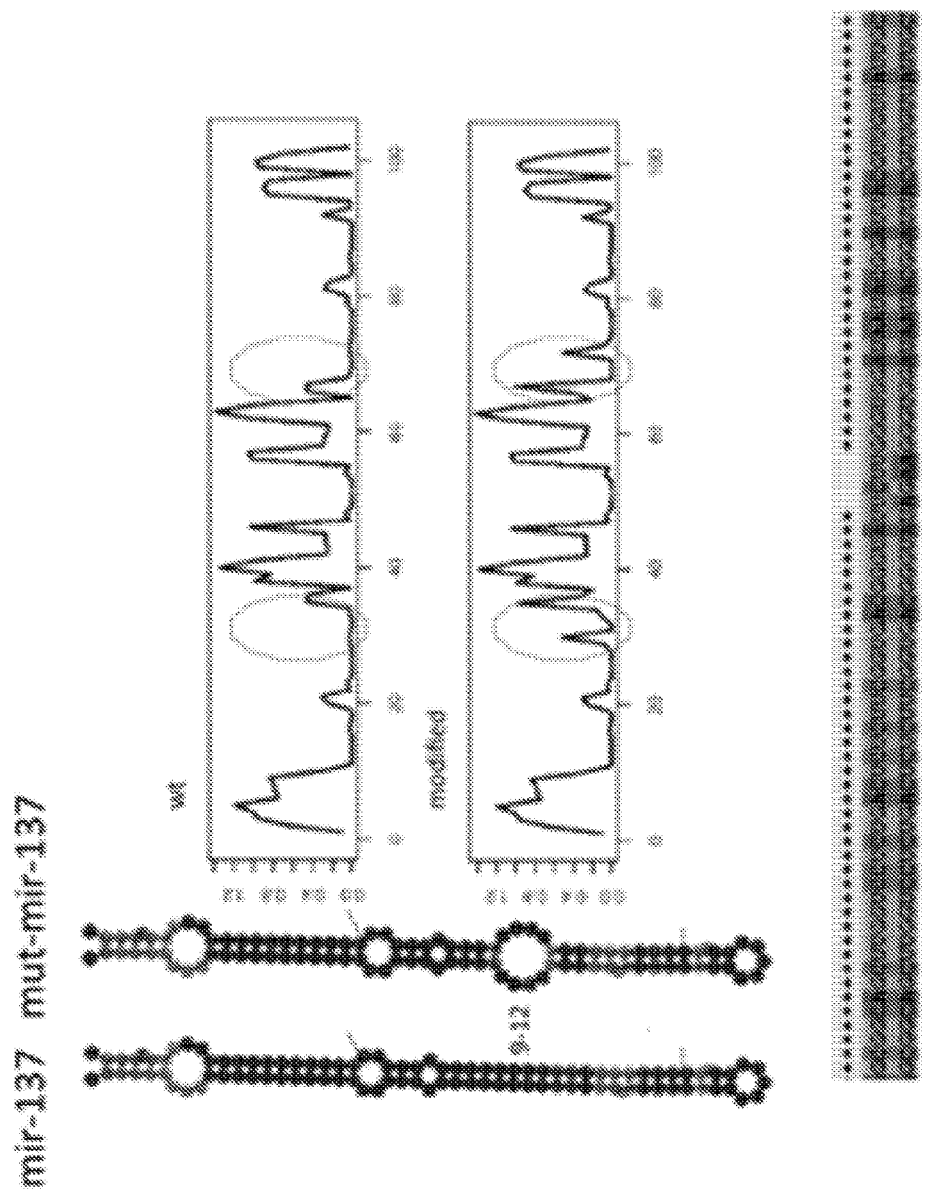
Figure 7C:
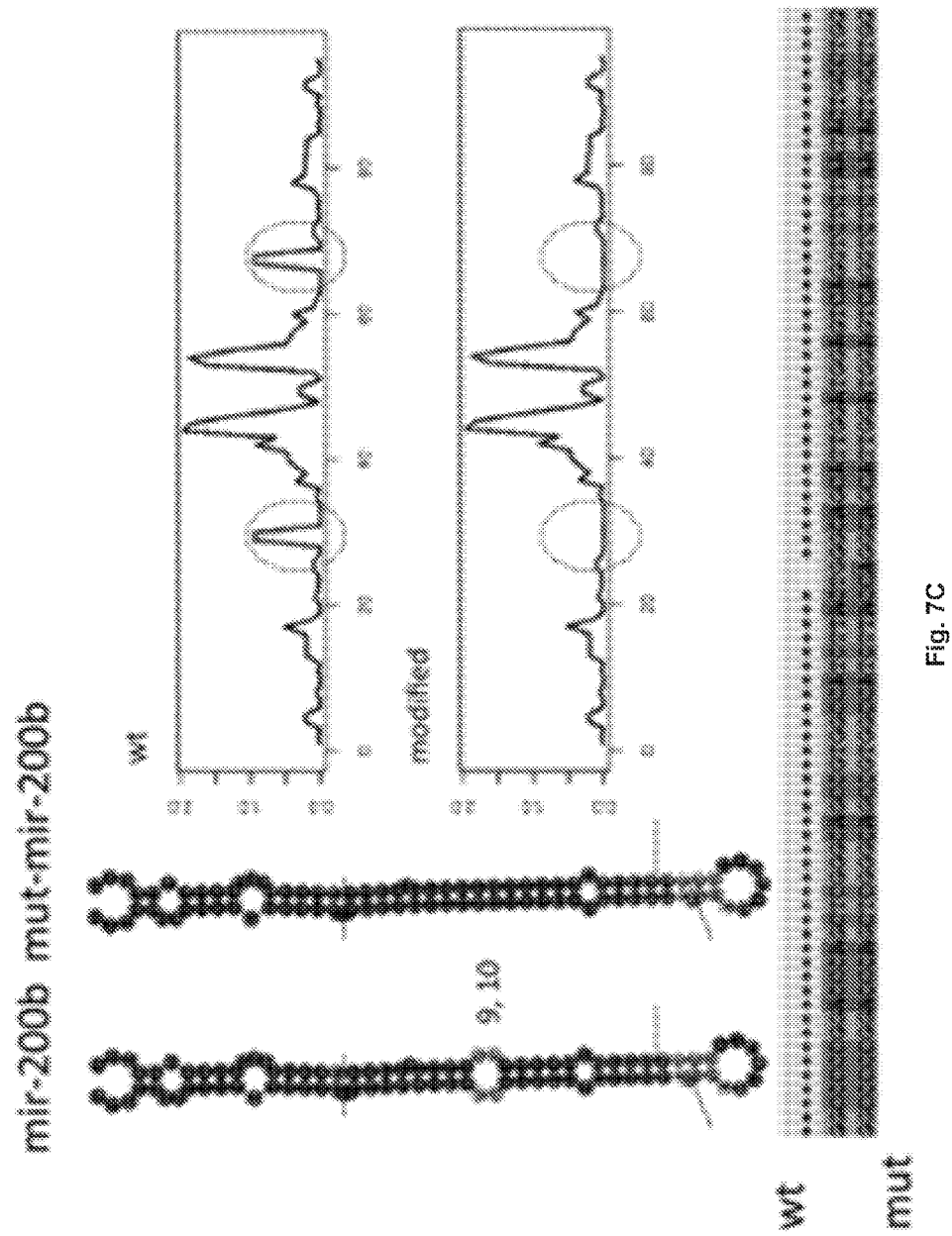
Figure 7D:
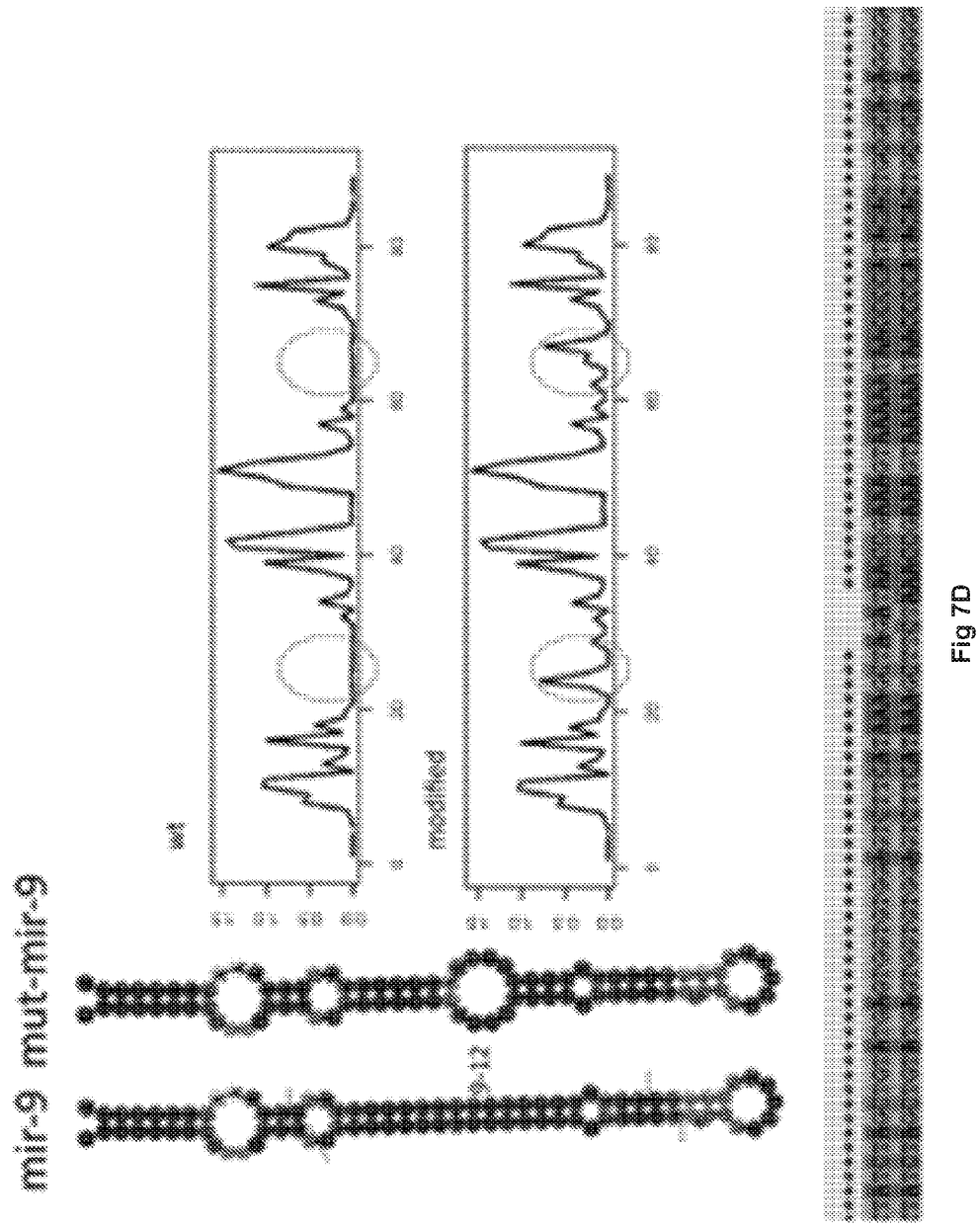
Figure 15:
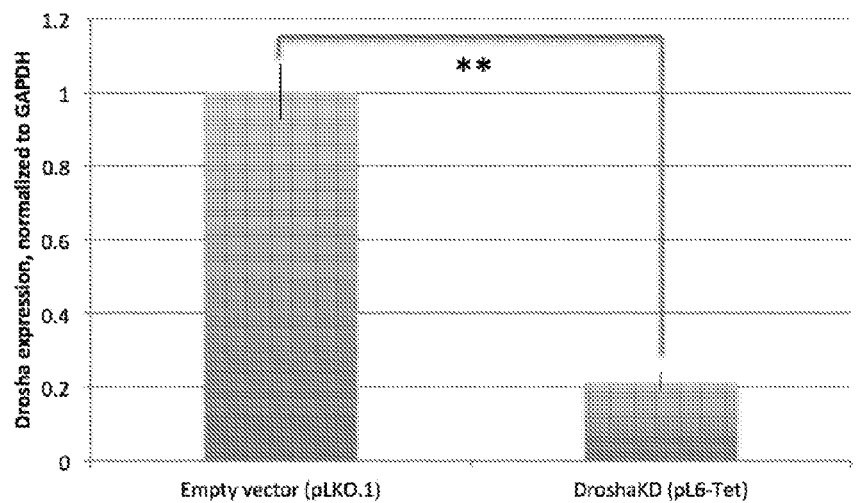
FIG. 15. DroshaKD in HeLa cells, verification of expression levels. Drosha levels measured by qPCR and normalized to GAPDH. 7 biological replicates showed an average 9-fold knock down (log p<−5) (A). Drosha protein expression levels measured by western blotting, normalized to β-actin. 3 biological replicates showed an average 5-fold knockdown (p<0.05) (B)
Figure 15:
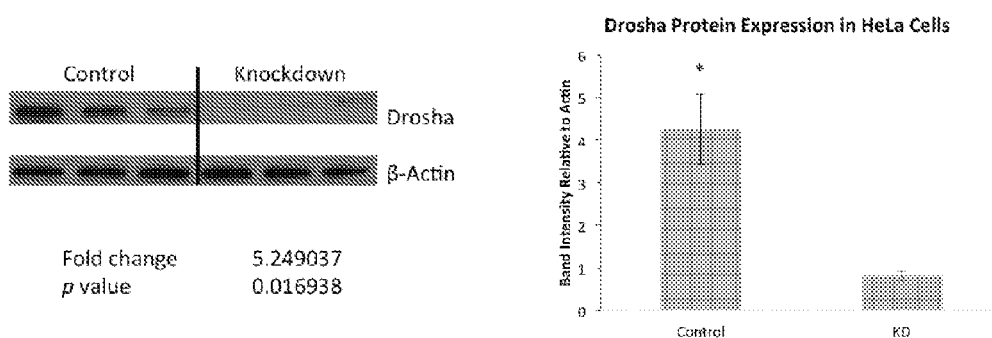
Figure 16:
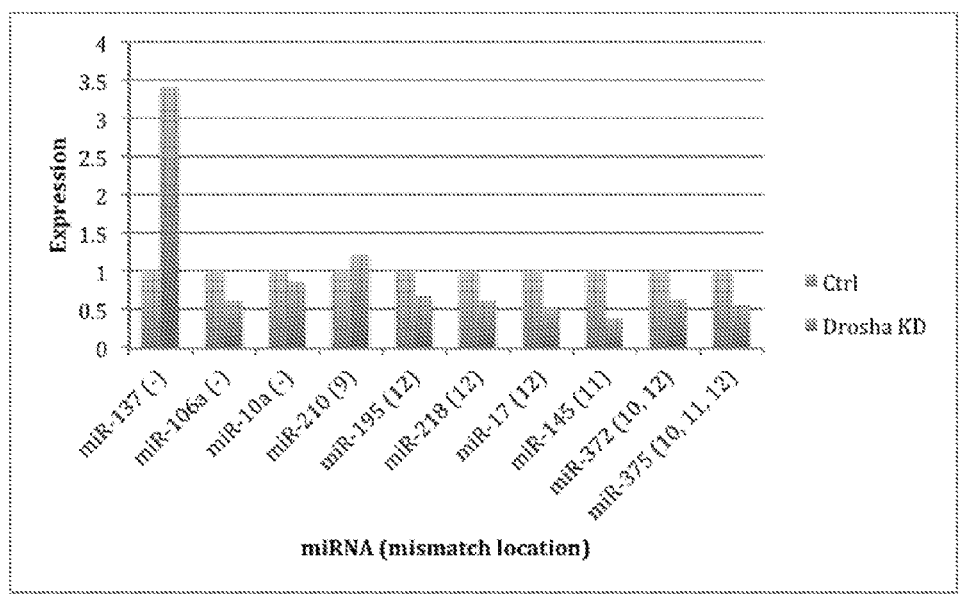
FIG. 16. Endogenous miRNA levels in DroshaKD and control cells. Endogenous levels for a random selection of miRNAs were measured by TaqMan qPCR, normalized to RNU66. The miRNAs are sorted right to left by increasing number of mismatches in region 9-12 nucleotides from the Drosha cutting site.

Biochemical validation of the relationship between pri-miRNA secondary structure, miRNA expression, and Drosha expression in viva Given the spatial and developmental heterogeneity of Drosha expression and its' correlation with miRNA expression based on secondary structure (FIG. 3-6), it was hypothesized that mismatches in a miRNA hairpin approximately 9-12 nt from the Drosha cutting site would confer increased sensitivity to low levels of Drosha. Conversely, the absence of mismatches would confer decreased sensitivity to Drosha expression. In order to test this hypothesis, the relative over expression of four miRNAs in two HeLa cell lines were compared; one with a stable Drosha knockdown, the other transduced with a control virus (Control). Drosha protein levels were significantly reduced in the KD line (5-fold reduction; FIG. 12) resulting in downregulation of endogenous miRNAs (FIG. 15). miR-145 and miR-200b were selected for over-expression in these cells due to the clear presence of mismatches 9-12 nt from the Drosha cutting site (FIG. 7A-B), making them ideal candidates to represent miRNAs at one end of the spectrum with regards to secondary structure. For the same reason, miR-137 and miR-9-1 were selected due to the clear absence of mismatches 9-12 nt from the Drosha cutting site (FIG. 7C-D). Modifications of the 9-12 nt region were designed to either insert or remove mismatches without disrupting the rest of the hairpin, while preserving the primary sequence of the mature miRNA, changing each miRNA from one extreme structure to the other while allowing for detection by traditional methods (FIG. 7A-D). Because alteration of the secondary structure close to the Drosha cutting site has previously been shown to completely disrupt processing and may affect strand selection during RISC loading, this region was not modified. (Zeng and Cullen 2003; Noland et al. 2011) Fold change of miRNA over expression (KD/ctrl; referred to as "relative over expression") was measured by qPCR to determine whether or not mismatches in the central region determine sensitivity to Drosha in vivo.

Figure 8:
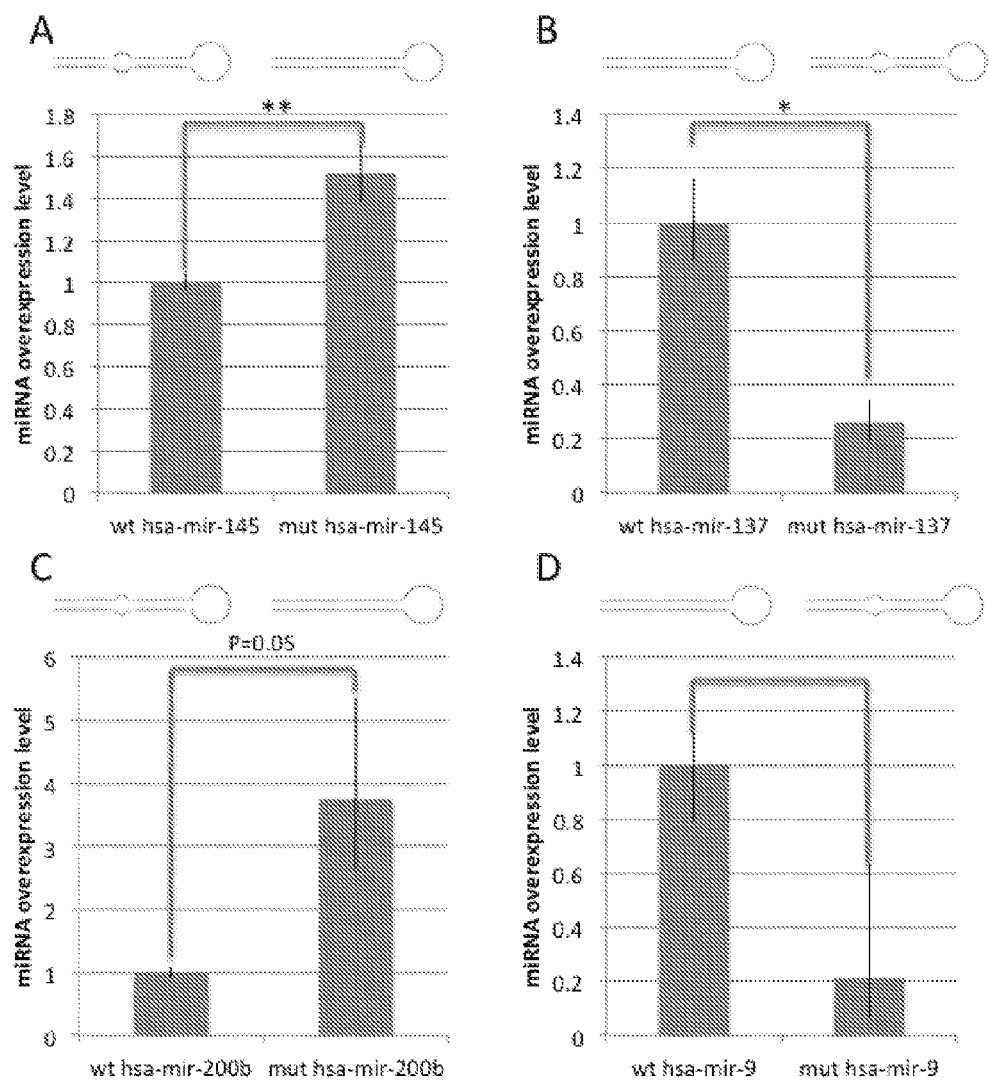
FIG. 8. Fold change of over expression levels of wild type and mutated versions of miR-145 (A), -137 (B), -200b (C) and -9 (D) between Drosha knockdown and control HeLa cells, assayed by TaqMan® probes and normalized to RNU66. (n=3). Transfection efficiency was accounted for by SYBRgreen® qPCR of the bleomycin resistance gene in the vector, normalized to GAPDH and subtracted from the ΔCt values from the TaqMan® assays. Final normalization was made to the fold change of over expression for each wt construct. Statistical significance was calculated using a student's t-test, resulting in p-values of <0.01 (mir-145), <0.05 (mir-137), =0.05 (mir-200b).

For miR-145, mutation from a semi-rigid to a rigid stem increased relative over expression by 1.52-fold, p<0.01 (FIG. 8A). For miR-137, mutation from a rigid stem to a less rigid stem decreased relative over expression by 3.84-fold, p<0.05 (FIG. 8B). For miR-200b, mutation from a quasi-rigid to a more rigid stem increased relative over-expression by 3.76-fold, p=0.05 (FIG. 8C). For miR-9-1, mutation to create mismatches in the 9-12 nt region decreased relative over-expression by 4.66-fold (FIG. 8D). These data show that the addition or removal of mismatches did affect the level of miRNA overexpression in DroshaKD/Control, with more mismatches generating a lower ratio than the corresponding miRNA without mismatches 9-12 nt from the Drosha cutting site.

Figure 9:
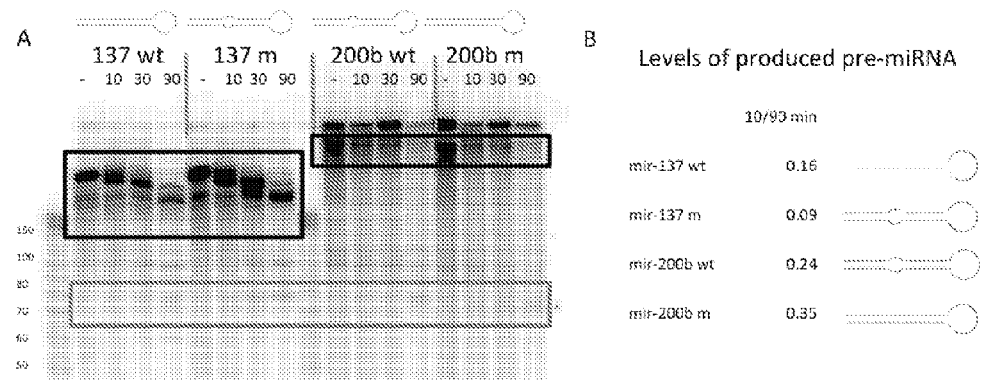
FIG. 9. in vitro processing of miRNAs using nuclear extract. A. in vitro transcribed miRNAs, processed by 293T cell nuclear extract and visualized on a 10% urea-polyacrylamide gel. Bands corresponding to processed pre-miRNAs are marked in grey, and areas containing pri-miRNAs used for normalization are labeled in black. B. 10/90 minute ratios of quantified pre-miRNA levels normalized to each respective pri-miRNA levels.

In vitro processing of modified miRNAs. Having shown the differential processing of rigid and mismatched miRNAs in vivo, this relationship was tested in vitro. Linearized plasmids containing wild type (wt) and modified versions of mir-137 (203 nt) and mir-200b (430 nt) were in vitro transcribed and radiolabeled, followed by Drosha processing for 10, 30 and 90 minutes using nuclear extract from 293T cells. The resulting RNA was purified and visualized on a 10% urea-polyacrylamide gel (FIG. 9A). Intensities of the bands corresponding to the pre-miRNA were quantified and normalized to the intensities of the regions containing pri-miRNA. Negative controls using only protein buffer and no lysate showed no detection in the bands used to quantify pre-miRNAs. Calculation of expression ratios of normalized 10 min and 90 min samples showed a consistently higher ratio for more rigid miRNAs than for their more mismatched counterparts (FIG. 9B). While the fold changes are smaller in in vitro assay compared to in vivo experiments (compare FIG. 8B-C to FIG. 9), the trend is the same, consistently showing that mismatched miRNAs have a higher sensitivity to reduced Drosha activity.

Discussion

It has been shown that when Drosha levels change, the change in expression levels of miRNAs with mismatches in the hairpin, 9-12 nt from the Drosha cutting site is greater than the change in expression levels of miRNAs that lack mismatches in the same region. This correlation was found in mature mouse tissues and during development. The sensitivity to changes in Drosha expression for miRNAs was also achieved by changing their secondary structure. These data suggest that secondary structure of miRNA affects miRNA's processing efficiency when Drosha is limiting and that differentiating cells may use this as a means of miRNA regulation.

Previous work on standardizing the miRNA secondary structure and cataloguing mismatch locations has used the approach of assigning mismatch positions for each strand of the hairpin separately (Han et al. 2006). In order to improve the representation of mismatch locations in three dimensional space, a mismatch mapping technique was developed that takes both strands into consideration simultaneously in the analysis. This counting method resulted in a very consistent measurement of 21 nt between the Drosha and Dicer cutting sites, which is consistent with previous reports indicating that Dicer processing of pre-miRNAs with asymmetric mismatches seems to explain the heterogeneity of length observed amongst mature miRNAs, and is also consistent with the idea that Dicer processing utilizes 'molecular rulers' which are size invariant (Starega-Roslan et al. 2010), which indicates that the developed counting method provides a good representation of the shape of the miRNA.

A relationship between secondary structure and pri-miRNA processing is well established, but no previous studies have focused specifically on the 9-12 nt region within the pre-miRNA portion of the pri-miRNA and processing. pri-miRNAs are generally shorter, have fewer bulges and internal loops, and overall less mismatched bases within the stem region than non-miRNA-generating RNA transcripts, implying that secondary structure prediction is a reliable predictor of Drosha and Dicer processing (Ritchie et al. 2007). Furthermore, the secondary structure of pri-miRNAs controls the specificity and efficiency of Drosha processing, in vitro and in vivo, suggesting that Drosha substrate specificity may act as a mechanism for global regulation of miRNA expression profiles (Feng et al. 2011). On the other hand, it has also been shown that polymorphisms in pri-miRNA secondary structure do not affect processing (Diederichs and Haber 2006), but only one of the examined single nucleotide polymorphisms (SNPs) was within the pre-miRNA portion of the pri-miRNA structure. In a wider search of human miRNA genes, it was determined that SNPs did affect the processing and function of miRNAs and most of these SNPs were found between the Dicer and Drosha cutting sites (Sun et al. 2009). The results presented herein could explain the significance of SNPs outside the seed region, but within the pre-miRNA structure, of some cancer and disease related miRNAs, such as the mutation in the stem of hsa-mir-125a (Duan et al. 2007), or in miR-181b-2, miR-208, miR-520e (Wu et al. 2008).

The miRNA biogenesis is regulated on multiple levels. The transcription of primary miRNAs (pri-miRNA) is regulated by common transcription factors, e.g. c-Myc (Abdelmohsen et al. 2012), and some miRNAs are also found to be subject to methylation (Brueckner et al. 2007). miRNAs are transcribed in the nucleus by RNA polymerase II or III (Borchert et al. 2006; Kim and Nam 2006) as part of the pri-miRNA, whose length is highly variable, ranging from ~200 up to several thousand nucleotides (Du and Zamore 2005; Cullen 2006). Drosha and DGCR8 bind the pri-miRNA, and Drosha cleaves pri-miRNAs at the base of the stem-loop and liberates a structure known as the precursor microRNA (pre-miRNA), which is ~60-70 nucleotides in length and forms a frequently mismatched hairpin structure with a 2 nucleotide 3' overhang (Basyuk et al. 2003; Lee et al. 2003; Ritchie et al. 2007). The DGCR8 mRNA has stem loop structures that can be cleaved by the Microprocessor, accordingly giving the Microprocessor a self regulating mechanism (Han et al. 2009). The pre-miRNA is transported from the nucleus to the cytoplasm by Exportin-5 and is subsequently cleaved by the enzyme Dicer with its cofactor trans-activator RNA (tar)-binding protein (TRBP) (Chendrimada et al. 2005), with a notable exception in mir-451, which bypasses Dicer cleavage and is processed by Ago instead (Cheloufi et al. 2010). Dicer cleavage is further regulated by Lin28, which binds to pre-miRNAs from the let-7 family (Nam et al. 2011). Dicer acts by binding the 3'-overhang and cleaves the pri-miRNA ~22 nt from the Drosha-cutting site to remove the terminal loop, resulting in an imperfect ~22 nt called miRNA:miRNA* (Hutvagner et al. 2001; Bernstein and Allis 2005; Feng et al. 2012). The miRNA enters the RNA-induced silencing complex (RISC), and the miRNA* is degraded, in a process where strand selection is variable (Bartel 2004; Du and Zamore 2005; Cullen 2006; Kim and Nam 2006). Although several mechanisms have been identified by which expression levels of select miRNAs are affected, and though Drosha is known to regulate overall Drosha expression, it has never previously been shown that the cell selectively can change miRNA expression profiles by altering levels of Drosha expression.

The current disclosure shows that Drosha levels vary between tissues and throughout cellular development, and that miRNAs without mismatches in the 9-12 nt region are overrepresented in cells with low levels of Drosha, while highly mismatched miRNAs are highly expressed in cells with high levels of Drosha, and that this behavior can be altered by changing the miRNA secondary structure. This supports the hypothesis that the cell selectively regulates more rigid and more mismatched miRNAs by altering Drosha expression. This mechanism contributes to the phenotypic relevance of specific levels of Drosha expression in development and terminal differentiation. In addition to other examples of post-transcriptional regulation, this can explain why some polycistronic miRNAs that are driven by the same promoter have very different expression levels, and the impact of SNPs, as stated above. This mechanism may be utilized while designing artificial miRNAs to increase stability, control expression levels throughout differentiation, or fine-tune miRNA expression in different tissue types.

As will be understood by one of ordinary skill in the art, each embodiment disclosed herein can comprise, consist essentially of or consist of its particular stated element, step, ingredient or component. As used herein, the transition term "comprise" or "comprises" means includes, but is not limited to, and allows for the inclusion of unspecified elements, steps, ingredients, or components, even in major amounts. The transitional phrase "consisting of" excludes any element, step, ingredient or component not specified. The transition phrase "consisting essentially of" limits the scope of the embodiment to the specified elements, steps, ingredients or components and to those that do not materially affect the embodiment. As used herein, a material effect would result in an RNA that remains relatively unaffected by Drosha regulation when compared to an RNA with a different number of mismatches in positions 5 and 9-12 from the Drosha cutting site.

Unless otherwise indicated, all numbers expressing quantities of ingredients, properties such as molecular weight, reaction conditions, and so forth used in the specification and claims are to be understood as being modified in all instances by the term "about." Accordingly, unless indicated to the contrary, the numerical parameters set forth in the specification and attached claims are approximations that may vary depending upon the desired properties sought to be obtained by the present invention. At the very least, and not as an attempt to limit the application of the doctrine of equivalents to the scope of the claims, each numerical parameter should at least be construed in light of the number of reported significant digits and by applying ordinary rounding techniques. When further clarity is required, the term "about" has the meaning reasonably ascribed to it by a person skilled in the art when used in conjunction with a stated numerical value or range, i.e. denoting somewhat more or somewhat less than the stated value or range, to within a range of ±20% of the stated value; ±19% of the stated value; ±18% of the stated value; ±17% of the stated value; ±16% of the stated value; ±15% of the stated value; ±14% of the stated value; ±13% of the stated value; ±12% of the stated value; ±11% of the stated value; ±10% of the stated value; ±9% of the stated value; ±8% of the stated value; ±7% of the stated value; ±6% of the stated value; ±5% of the stated value; ±4% of the stated value; ±3% of the stated value; ±2% of the stated value; or ±1% of the stated value.

Notwithstanding that the numerical ranges and parameters setting forth the broad scope of the invention are approximations, the numerical values set forth in the specific examples are reported as precisely as possible. Any numerical value, however, inherently contains certain errors necessarily resulting from the standard deviation found in their respective testing measurements.

The terms "a," "an," "the" and similar referents used in the context of describing the invention (especially in the context of the following claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein is intended merely to better illuminate the invention and does not pose a limitation on the scope of the invention otherwise claimed. No language in the specification should be construed as indicating any non-claimed element essential to the practice of the invention.

Groupings of alternative elements or embodiments of the invention disclosed herein are not to be construed as limitations. Each group member may be referred to and claimed individually or in any combination with other members of the group or other elements found herein. It is anticipated that one or more members of a group may be included in, or deleted from, a group for reasons of convenience and/or patentability. When any such inclusion or deletion occurs, the specification is deemed to contain the group as modified thus fulfilling the written description of all Markush groups used in the appended claims.

Certain embodiments of this invention are described herein, including the best mode known to the inventors for carrying out the invention. Of course, variations on these described embodiments will become apparent to those of ordinary skill in the art upon reading the foregoing description. The inventor expects skilled artisans to employ such variations as appropriate, and the inventors intend for the invention to be practiced otherwise than specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

Furthermore, numerous references have been made to patents and printed publications throughout this specification. Each of the above-cited references and printed publications are individually incorporated herein by reference in their entirety.

In closing, it is to be understood that the embodiments of the invention disclosed herein are illustrative of the principles of the present invention. Other modifications that may be employed are within the scope of the invention. Thus, by way of example, but not of limitation, alternative configurations of the present invention may be utilized in accordance with the teachings herein. Accordingly, the present invention is not limited to that precisely as shown and described.

The particulars shown herein are by way of example and for purposes of illustrative discussion of the preferred embodiments of the present invention only and are presented in the cause of providing what is believed to be the most useful and readily understood description of the principles and conceptual aspects of various embodiments of the invention. In this regard, no attempt is made to show structural details of the invention in more detail than is necessary for the fundamental understanding of the invention, the description taken with the drawings and/or examples making apparent to those skilled in the art how the several forms of the invention may be embodied in practice.

Definitions and explanations used in the present disclosure are meant and intended to be controlling in any future construction unless clearly and unambiguously modified in the following examples or when application of the meaning renders any construction meaningless or essentially meaningless. In cases where the construction of the term would render it meaningless or essentially meaningless, the definition should be taken from Webster's Dictionary, 3rd Edition or a dictionary known to those of ordinary skill in the art, such as the Oxford Dictionary of Biochemistry and Molecular Biology (Ed. Anthony Smith, Oxford University Press, Oxford, 2004).

REFERENCES

Abdelmohsen K, Srikantan S, Kang M J, Gorospe M. 2012. Regulation of senescence by microRNA biogenesis factors. *Ageing Res Rev* 11(4): 491-500.

Anokye-Danso F, Trivedi C M, Juhr D, Gupta M, Cui Z, Tian Y, Zhang Y, Yang W, Gruber P J, Epstein J A et al. 2011. Highly efficient miRNA-mediated reprogramming of mouse and human somatic cells to pluripotency. *Cell Stem Cell* 8(4): 376-388.

Bar M, Wyman S K, Fritz B R, Qi J, Garg K S, Parkin R K, Kroh E M, Bendoraite A, Mitchell P S, Nelson A M et al. 2008. MicroRNA discovery and profiling in human embryonic stem cells by deep sequencing of small RNA libraries. *Stem Cells* 26(10): 2496-2505.

Bartel D P. 2004. MicroRNAs: genomics, biogenesis, mechanism, and function. *Cell* 116(2): 281-297.

Basyuk E, Suavet F, Doglio A, Bordonne R, Bertrand E. 2003. Human let-7 stem-loop precursors harbor features of RNase III cleavage products. *Nucleic Acids Res* 31(22): 6593-6597.

Berezikov E, Chung W J, Willis J, Cuppen E, Lai E C. 2007. Mammalian mirtron genes. *Mol Cell* 28(2): 328-336.

Bernstein E, Allis C D. 2005. RNA meets chromatin. *Genes Dev* 19(14): 1635-1655.

Borchert G M, Lanier W, Davidson B L. 2006. RNA polymerase III transcribes human microRNAs. *Nat Struct Mol Biol* 13(12): 1097-1101.

Brueckner B, Stresemann C, Kuner R, Mund C, Musch T, Meister M, Sultmann H, Lyko F. 2007. The human let-7a-3 locus contains an epigenetically regulated microRNA gene with oncogenic function. *Cancer Res* 67(4): 1419-1423.

Chambers S M, Fasano C A, Papapetrou E P, Tomishima M, Sadelain M, Studer L. 2009. Highly efficient neural conversion of human ES and iPS cells by dual inhibition of SMAD signaling. *Nat Biotechnol* 27(3): 275-280.

Cheloufi S, Dos Santos C O, Chong M M, Hannon G J. 2010. A dicer-independent miRNA biogenesis pathway that requires Ago catalysis. *Nature* 465(7298): 584-589.

Chendrimada T P, Gregory R I, Kumaraswamy E, Norman J, Cooch N, Nishikura K, Shiekhattar R. 2005. TRBP recruits the Dicer complex to Ago2 for microRNA processing and gene silencing. *Nature* 436(7051): 740-744.

Chong M M, Zhang G, Cheloufi S, Neubert T A, Hannon G J, Littman D R. 2010. Canonical and alternate functions of the microRNA biogenesis machinery. *Genes Dev* 24(17): 1951-1960.

Cullen B R. 2006. Viruses and microRNAs. *Nat Genet* 38 Suppl: S25-30.

Davis B N, Hata A. 2009. Regulation of MicroRNA Biogenesis: A miRiad of mechanisms. *Cell Commun Signal* 7: 18.

Davis B N, Hilyard A C, Lagna G, Hata A. 2008. SMAD proteins control DROSHA-mediated microRNA maturation. *Nature* 454(7200): 56-61.

Diederichs S, Haber D A. 2006. Sequence variations of microRNAs in human cancer: alterations in predicted secondary structure do not affect processing. *Cancer Res* 66(12): 6097-6104.

Du T, Zamore P D. 2005. microPrimer: the biogenesis and function of microRNA. *Development* 132(21): 4645-4652.

Duan R, Pak C, Jin P. 2007. Single nucleotide polymorphism associated with mature miR-125a alters the processing of pri-miRNA. *Hum Mol Genet* 16(9): 1124-1131.

Feng Y, Zhang X, Graves P, Zeng Y. 2012. A comprehensive analysis of precursor microRNA cleavage by human Dicer. *RNA* 18(11): 2083-2092.

Feng Y, Zhang X, Song Q, Li T, Zeng Y. 2011. Drosha processing controls the specificity and efficiency of global microRNA expression. *Biochim Biophys Acta* 1809 (11-12): 700-707.

Fukuda T, Yamagata K, Fujiyama S, Matsumoto T, Koshida I, Yoshimura K, Mihara M, Naitou M, Endoh H, Nakamura T et al. 2007. DEAD-box RNA helicase subunits of the Drosha complex are required for processing of rRNA and a subset of microRNAs. *Nat Cell Biol* 9(5): 604-611.

Gregory R I, Yan K P, Amuthan G, Chendrimada T, Doratotaj B, Cooch N, Shiekhattar R. 2004. The Microprocessor complex mediates the genesis of microRNAs. *Nature* 432 (7014): 235-240.

Griffiths-Jones S, Grocock R J, van Dongen S, Bateman A, Enright A J. 2006. miRBase: microRNA sequences, targets and gene nomenclature. *Nucleic Acids Res* 34 (Database issue): D140-144.

Han J, Lee Y, Yeom K H, Nam J W, Heo I, Rhee J K, Sohn S Y, Cho Y, Zhang B T, Kim V N. 2006. Molecular basis for the recognition of primary microRNAs by the Drosha-DGCR8 complex. *Cell* 125(5): 887-901.

Han J, Pedersen J S, Kwon S C, Belair C D, Kim Y K, Yeom K H, Yang W Y, Haussler D, Blelloch R, Kim V N. 2009. Posttranscriptional crossregulation between Drosha and DGCR8. *Cell* 136(1): 75-84.

Hatfield S D, Shcherbata H R, Fischer K A, Nakahara K, Carthew R W, Ruohola-Baker H. 2005. Stem cell division is regulated by the microRNA pathway. *Nature* 435(7044): 974-978.

Hofacker I L, Fontana W, Stadler P F, Bonhoeffer L S, Tacker M, Schuster P. 1994. Fast folding and comparison of RNA secondary structures. *Monatsh Chem* 125: 167-188.

Hutvagner G, McLachlan J, Pasquinelli A E, Balint E, Tuschl T, Zamore P D. 2001. A cellular function for the RNA-interference enzyme Dicer in the maturation of the let-7 small temporal RNA. *Science* 293(5531): 834-838.

Kim V N, Nam J W. 2006. Genomics of microRNA. *Trends Genet* 22(3): 165-173.

Kuehbacher A, Urbich C, Zeiher A M, Dimmeler S. 2007. Role of Dicer and Drosha for endothelial microRNA expression and angiogenesis. *Circ Res* 101(1): 59-68.

Kuppusamy K T, Sperber H, Ruohola-Baker H. 2013. MicroRNA Regulation and role in stem cell maintenance, cardiac differentiation and hypertrophy. *Curr Mol Med* Submitted.

Lagos-Quintana M, Rauhut R, Lendeckel W, Tuschl T. 2001. Identification of novel genes coding for small expressed RNAs. *Science* 294(5543): 853-858.

Lee Y, Ahn C, Han J, Choi H, Kim J, Yim J, Lee J, Provost P, Radmark O, Kim S et al. 2003. The nuclear RNase III Drosha initiates microRNA processing. *Nature* 425(6956): 415-419.

Mattick J S, Makunin I V. 2006. Non-coding RNA. *Hum Mol Genet* 15 Spec No 1: R17-29.

Nam Y, Chen C, Gregory R I, Chou J J, Sliz P. 2011. Molecular basis for interaction of let-7 microRNAs with Lin28. *Cell* 147(5): 1080-1091.

Noland C L, Ma E, Doudna J A. 2011. siRNA repositioning for guide strand selection by human Dicer complexes. *Mol Cell* 43(1): 110-121.

O'Donnell K A, Wentzel E A, Zeller K I, Dang C V, Mendell J T. 2005. c-Myc-regulated microRNAs modulate E2F1 expression. *Nature* 435(7043): 839-843.

Qi J, Yu J Y, Shcherbata H R, Mathieu J, Wang A J, Seal S, Zhou W, Stadler B M, Bourgin D, Wang L et al. 2009. microRNAs regulate human embryonic stem cell division. *Cell Cycle* 8(22): 3729-3741.

Ritchie W, Legendre M, Gautheret D. 2007. RNA stem-loops: to be or not to be cleaved by RNAse III. *RNA* 13(4): 457-462.

Ruby J G, Jan C H, Bartel D P. 2007. Intronic microRNA precursors that bypass Drosha processing. *Nature* 448(7149): 83-86.

Shcherbata H R, Hatfield S, Ward E J, Reynolds S, Fischer K A, Ruohola-Baker H. 2006. The MicroRNA pathway plays a regulatory role in stem cell division. *Cell Cycle* 5(2): 172-175.

Stadler B, Ivanovska I, Mehta K, Song S, Nelson A, Tan Y, Mathieu J, Darby C, Blau C A, Ware C et al. 2010. Characterization of microRNAs involved in embryonic stem cell states. *Stem Cells Dev* 19(7): 935-950.

Stadler B M, Ruohola-Baker H. 2008. Small RNAs: keeping stem cells in line. *Cell* 132(4): 563-566.

Starega-Roslan J, Krol J, Koscianska E, Kozlowski P, Szlachcic W J, Sobczak K, Krzyzosiak W J. 2010. Structural basis of microRNA length variety. *Nucleic Acids Res* 39(1): 257-268.

Stark A, Brennecke J, Bushati N, Russell R B, Cohen S M. 2005. Animal MicroRNAs confer robustness to gene expression and have a significant impact on 3'UTR evolution. *Cell* 123(6): 1133-1146.

Sun G, Yan J, Noltner K, Feng J, Li H, Sarkis D A, Sommer S S, Rossi J J. 2009. SNPs in human miRNA genes affect biogenesis and function. *RNA* 15(9): 1640-1651.

Takada S, Berezikov E, Yamashita Y, Lagos-Quintana M, Kloosterman W P, Enomoto M, Hatanaka H, Fujiwara S, Watanabe H, Soda M et al. 2006. Mouse microRNA profiles determined with a new and sensitive cloning method. *Nucleic Acids Res* 34 (17): e115.

Wu M, Jolicoeur N, Li Z, Zhang L, Fortin Y, L'Abbe D, Yu Z, Shen S H. 2008. Genetic variations of microRNAs in human cancer and their effects on the expression of miR-NAs. *Carcinogenesis* 29(9): 1710-1716.

Zeng Y, Cullen B R. 2003. Sequence requirements for micro RNA processing and function in human cells. *RNA* 9(1): 112-123.

Zeng Y, Yi R, Cullen B R. 2005. Recognition and cleavage of primary microRNA precursors by the nuclear processing enzyme Drosha. *EMBO J* 24(1): 138-148.

Zisoulis D G, Kai Z S, Chang R K, Pasquinelli A E. 2012. Autoregulation of microRNA biogenesis by let-7 and Argonaute. *Nature* 486(7404): 541-544.

SEQUENCE LISTING (7056 sequences)

SEQ ID NO: 1 - RNA, 80 nt, Homo sapiens
ugggaugagguaguagguuguauaguuuuagggucacacccaccacugggagauaacuauacaaucuacugucuuuccua

SEQ ID NO: 2 - RNA, 72 nt, Homo sapiens
agguugagguaguagguuguauaguuuagaauuacaucaagggagauaacuguacagccuccuagcuuuccu

SEQ ID NO: 3 - RNA, 74 nt, Homo sapiens
gggugagguaguagguuguauaguuuggggcucugcccugcuaugggauaacuauacaaucuacugucuuuccu

SEQ ID NO: 4 - RNA, 83 nt, Homo sapiens
cggggugagguaguagguugugugguuucagggcagugauguugccccucggaagauaacuauacaaccuacugccuucccug

SEQ ID NO: 5 - RNA, 84 nt, Homo sapiens
gcauccggguugagguaguagguuguaugguuuagaguuacacccugggaguuaacuguacaaccuucuagcuuuccuuggagc

SEQ ID NO: 6 - RNA, 87 nt, Homo sapiens
ccuaggaagagguaguagguugcauaguuuuagggcagggauuuugcccacaaggagguaacuauacgaccugcugccuuucuuagg

SEQ ID NO: 7 - RNA, 79 nt, Homo sapiens
cccgggcugagguaggagguuguauaguugaggaggacacccaaggagaucacuauacggccuccuagcuuuccccagg

SEQ ID NO: 8 - RNA, 87 nt, Homo sapiens
ucagagugagguaguagauuguauaguugugggguagugauuuuacccuguucaggagauaacuauacaaucuauugccuucccuga

SEQ ID NO: 9 - RNA, 83 nt, Homo sapiens
ugugggaugagguaguagauuguauaguuuuagggucauaccccaucuuggagauaacuauacagucuacugucuuucccacg

SEQ ID NO: 10 - RNA, 84 nt, Homo sapiens
aggcugagguaguaguuuguacaguuugagggucuaugauaccacccgguacaggagauaacuguacaggccacugccuugcca

SEQ ID NO: 11 - RNA, 84 nt, Homo sapiens
cuggcugagguaguaguuugugcuguuggucggguugugacauugcccgcuguggagauaacugcgcaagcuacugccuugcua

SEQ ID NO: 12 - RNA, 80 nt, Homo sapiens
ccuguugccacaaacccguagauccgaacuugugguauuaguccgcacaagcuuguaucuauagguaugugucuguuagg

SEQ ID NO: 13 - RNA, 75 nt, Homo sapiens
ugcccuggcucaguuaucacagugcugaugcugucuauucuaaagguacaguacugugauaacugaaggauggca

SEQ ID NO: 14 - RNA, 79 nt, Homo sapiens
acuguccuuuuucgguuaucaugguaccgaugcuguauaucugaaagguacaguacugugauaacugaagaaugguggu

SEQ ID NO: 15 - RNA, 78 nt, Homo sapiens
uacugcccucggcuucuuuacagugcugccuuguugcauauggaucaagcagcauuguacagggcuaugaaggcauug

SEQ ID NO: 16 - RNA, 78 nt, Homo sapiens
uugugcuuucagcuucuuuacagugcugccuuguagcauucaggucaagcagcauuguacagggcuaugaaagaacca

SEQ ID NO: 17 - RNA, 62 nt, Homo sapiens
ucauagcccuguacaaugcugcuugauccauaugcaacaaggcagcacuguaaagaagccga

SEQ ID NO: 18 - RNA, 62 nt, Homo sapiens
ucauagcccuguacaaugcugcuugaccugaaugcuacaaggcagcacuguaaagaagcuga

SEQ ID NO: 19 - RNA, 81 nt, Homo sapiens
ugugcaucguggucaaaugcucagacuccugugguggcugcucaugcaccacggauguuugagcaugugcuacggugucua

SEQ ID NO: 20 - RNA, 81 nt, Homo sapiens
ugugcaucguggucaaaugcucagacuccugugguggcugcuuaugcaccacggauguuugagcaugugcuauggugucua

SEQ ID NO: 21 - RNA, 81 nt, Homo sapiens
ccuuggccauguaaaagugcuuacagugcagguagcuuuuugagaucuacugcaauguaagcacuucuuacauuaccaugg

SEQ ID NO: 22 - RNA, 82 nt, Homo sapiens
ccugccggggcuaaagugcugacagugcagauagugguccucuccgugcuaccgcacuguggguacuugcugcuccagcagg

SEQ ID NO: 23 - RNA, 81 nt, Homo sapiens
cucucugcuuucagcuucuuuacaguguugccuuguggcauggaguucaagcagcauuguacagggcuaucaaagcacaga

SEQ ID NO: 24 - RNA, 110 nt, Homo sapiens
gaucugucugucuucuguauauacccuguagauccgaauuuguguaaggaauuuuguggucacaaauucguaucuaggggaauauguaguugacauaaacacuccgcucu

SEQ ID NO: 25 - RNA, 110 nt, Homo sapiens
ccagagguuguaacguugucuauauauacccuguagaaccgaauuugugugguauccguauagucacagauucgauucuaggggaauauauggucgaugcaaaaacuuca

SEQ ID NO: 26 - RNA, 71 nt, Homo sapiens
ugggaaacauacuucuuuauaugcccauauggaccugcuaagcuauggaauguaaagaaguauguaucuca

SEQ ID NO: 27 - RNA, 85 nt, Homo sapiens
accuacucagaguacauacuucuuuauguacccauaugaacauacaaugcuauggaauguaaagaaguauguauuuuugguaggc

SEQ ID NO: 28 - RNA, 85 nt, Homo sapiens
ccuuagcagagcuguggagugugacaaugguguuugugucuaaacuaucaaacgccauuaucacacuaaauagcuacugcuaggc

SEQ ID NO: 29 - RNA, 85 nt, Homo sapiens
aggccucucucuccguguucacagcggaccuugauuuaaauguccauacaauuaaggcacgcggugaaugccaagaauggggcug

SEQ ID NO: 30 - RNA, 109 nt, Homo sapiens
aucaagauuagaggcucugcucuccguguucacagcggaccuugauuuaaugucauacaauuaaggcacgcggugaaugccaagagcggagccuacggcugcacuugaa

SEQ ID NO: 31 - RNA, 87 nt, Homo sapiens
ugagggccccucugcguguucacagcggaccuugauuuaaugucuauacaauuaaggcacgcggugaaugccaagagaggcgccucc

SEQ ID NO: 32 - RNA, 86 nt, Homo sapiens
ugccagucucuaggucccugagacccuuuaaccugugaggacauccagggucacaggugagguucuugggagccuggcgucuggcc

SEQ ID NO: 33 - RNA, 88 nt, Homo sapiens
ugcgcuccucucagucccugagacccuaacuugugauguuuaccguuuaaauccacggguuaggcucuugggagcugcgagucgugcu

SEQ ID NO: 34 - RNA, 89 nt, Homo sapiens
accagacuuuuccuagucccugagacccuaacuugugagguauuuuaguaacaucacaagucaggcucuugggaccuaggcggagggga

SEQ ID NO: 35 - RNA, 85 nt, Homo sapiens
cgcuggcgacgggacauuauuacuuuugguacgcgcugugacacuucaaacucguaccgugaguaauaaugcgccguccacggca

SEQ ID NO: 36 - RNA, 97 nt, Homo sapiens
ugugaucacugucuccagccugcugaagcucagagggcucugauucagaaagaucaucggauccgucugagcuuggcuggucggaagucucaucauc

SEQ ID NO: 37 - RNA, 82 nt, Homo sapiens
ugagcuguuggauucggggccguagcacugucugagagguuuacauuucucacagugaaccggucucuuuuucagcugcuuc

SEQ ID NO: 38 - RNA, 84 nt, Homo sapiens
ugugcagugggaaggggggccgauacacuguacgagagugaguagcaggucucacagugaaccggucucuuucccuacuguguc

SEQ ID NO: 39 - RNA, 72 nt, Homo sapiens
ggaucuuuuugcggucugggcuugcuguuccucucaacaguagucaggaagcccuuaccccaaaaaguaucu

SEQ ID NO: 40 - RNA, 90 nt, Homo sapiens
ugcccuucgcgaaucuuuuugcggucugggcuugcuguacauaacucaauagccggaagcccuuaccccaaaaagcauuugcggagggcg

SEQ ID NO: 41 - RNA, 89 nt, Homo sapiens
ugcugcuggccagagcucuuuucacauugugcuacugucugcaccugucacuagcagugcaauguuaaaagggcauuggccguguagug

SEQ ID NO: 42 - RNA, 82 nt, Homo sapiens
ggccugcccgacacucuuucccuguugcacuacuauaggccgcugggaagcagugcaaugaugaaagggcaucggucagguc

SEQ ID NO: 43 - RNA, 101 nt, Homo sapiens
ccgcccccgcgucuccagggcaaccguggcuuucgauuguuacugugggaacuggagguaacagucuacagccauggucgccccgcagcacgcccacgcgc

SEQ ID NO: 44 - RNA, 88 nt, Homo sapiens
acaaugcuuugcuagagcugguaaaauggaaccaaaucgccucuucaauggauuugguccccuucaaccagcuguagcuaugcauuga

SEQ ID NO: 45 - RNA, 102 nt, Homo sapiens
gggagccaaaugcuuugcuagagcugguaaaauggaaccaaaucgacuguccaauggauuugguccccuucaaccagcuguagcugugcauugauggcgccg

SEQ ID NO: 46 - RNA, 119 nt, Homo sapiens
ccucagaagaaagaugcccccugcucuggcuggucaaacggaaccaaguccgucuuccugagagguuugguccccuucaaccagcuacagcagggcuggcaaugcccaguccuuggaga

SEQ ID NO: 47 - RNA, 73 nt, Homo sapiens
cagggugugugacugguugaccagaggggcaugcacuguguucacccugugggccaccuagucaccaacccuc

SEQ ID NO: 48 - RNA, 90 nt, Homo sapiens
aggccucgcuguucucuauggcuuuuuauuccuaugugauucuacugcucacucauauagggauuggagccguggcgcacggcggggaca

SEQ ID NO: 49 - RNA, 100 nt, Homo sapiens
agauaaauucacucuagugcuuuauggcuuuuuauuccuaugugauaguaauaaagucucauguagggauggaagccaugaaauacauugugaaaaauca

SEQ ID NO: 50 - RNA, 97 nt, Homo sapiens
cacucugcuguggccuauggcuuuucauuccuaugugauugcugucccaaacucauguagggcuaaaagccaugggcuacagugaggggcgagcucc

SEQ ID NO: 51 - RNA, 82 nt, Homo sapiens
ugagcccucggaggacuccauuuguuuugaugauggauucuuaugcuccaucaucgucucaaaugagucuucagaggguucu

SEQ ID NO: 52 - RNA, 102 nt, Homo sapiens
gguccucugacucucuucggugacggguauucuuggguggauaauacggauuacguuguuauugcuuaagaauacgcguagucgaggagaguaccagcggca

SEQ ID NO: 53 - RNA, 99 nt, Homo sapiens
cccuggcauggugugguggggcagcugguguugugaaucaggccguugccaaucagagaacggcuacuucacaacaccagggccacaccacacuacagg

SEQ ID NO: 54 - RNA, 84 nt, Homo sapiens
cguugcugcagcugguguugugaaucaggccgacgagcagcgcauccucuuacccggcuauuucacgacaccaggguugcauca

SEQ ID NO: 55 - RNA, 68 nt, Homo sapiens
guguauucuacagugcacgugucuccaguguggcucggaggcuggagacgcggcccuguuggaguaac

SEQ ID NO: 56 - RNA, 100 nt, Homo sapiens
ugugucucucucuguguccugccagugguuuuacccuaugguagguuacgucaugcuguucuaccacaggguagaaccacggacaggauaccggggcacc

SEQ ID NO: 57 - RNA, 95 nt, Homo sapiens
cggccggcccuggguccaucuuccaguacaguguuggauggucuaauugugaagcuccuaacacugucugguaaagauggcucccggguggguuc

SEQ ID NO: 58 - RNA, 87 nt, Homo sapiens
gacagugcagucacccauaaaguagaaagcacuacuaacagcacuggaggguguaguguuuccuacuuuauggaugaguguacugug

SEQ ID NO: 59 - RNA, 106 nt, Homo sapiens
gcgcagcgcccugucucccagccugaggugcagugcugcaucucuggucaguugggagucugagaugaagcacuguagcucaggaagagagaaguuguucugcagc

SEQ ID NO: 60 - RNA, 86 nt, Homo sapiens
uggggcccuggcugggauaucaucauauacuguaaguuugcgaugagacacuacaguauagaugauguacuaguccgggcaccccc

SEQ ID NO: 61 - RNA, 88 nt, Homo sapiens
caccuuguccucacgguccaguuuucccaggaaucccuuagaugcuaagauggggauuccuggaaauacuguucuugaggucaugguu

SEQ ID NO: 62 - RNA, 99 nt, Homo sapiens
ccgauguguauccucagcuuugagaacugaauuccauggguugugucagugucagaccucugaaauucaguucuucagcugggauaucucugucaucgu

SEQ ID NO: 63 - RNA, 73 nt, Homo sapiens
ccuggcacugagaacugaauuccauaggcugugagcucuagcaaugcccuguggacucaguucuggugcccgg

SEQ ID NO: 64 - RNA, 72 nt, Homo sapiens
aaucuaaagacaacauuucugcacacacaccagacuauggaagccaguguguggaaaugcuucugcuagauu

SEQ ID NO: 65 - RNA, 80 nt, Homo sapiens
uauaaaucuaguggaaacauuucugcacaaacuagauucuggacaccagugugcggaaaugcuucugcuacauuuuuagg

SEQ ID NO: 66 - RNA, 68 nt, Homo sapiens
gaggcaaaguucugagacacuccgacucugaguaugauagaagucagugcacuacagaacuuugucuc

SEQ ID NO: 67 - RNA, 99 nt, Homo sapiens
caagcacgauuagcauuugaggugaaguucuguuauacacucaggcuguggcucucugaaagucagugcaucacagaacuuugucucgaaagcuuucua

SEQ ID NO: 68 - RNA, 89 nt, Homo sapiens
gccggcgcccgagcucuggcuccgugucuucacucccgugcuuguccgaggagggagggagggacgggggcugugcuggggcagcugga

SEQ ID NO: 69 - RNA, 84 nt, Homo sapiens
cuccccauggcccugucucccaacccuuguaccagugcugggcucagacccugguacaggccugggggacagggaccuggggac

SEQ ID NO: 70 - RNA, 90 nt, Homo sapiens
uuuccugcccucgaggagcucacagucuaguaugucucauccccuacuagacugaagcuccuugaggacagggauggucauacucaccuc

SEQ ID NO: 71 - RNA, 96 nt, Homo sapiens
accucugaugugucagucucucuucagggcucccgagacacagaaacagacaccugcccucgaggagcucacagucuagacaaacaaacccagggu

SEQ ID NO: 72 - RNA, 87 nt, Homo sapiens
ugucccccccggcccagguucugugauacacuccgacucgggcucuggagcagucagugcaugacagaacuugggcccggaaggacc

SEQ ID NO: 73 - RNA, 90 nt, Homo sapiens
cucacagcugccagugucauuuuugugaucugcagcuaguauucucacuccaguugcauagucacaaaagugaucauuggcagguguggc

SEQ ID NO: 74 - RNA, 87 nt, Homo sapiens
agcgguggccagugucauuuuugugauguugcagcuaguaauaugagcccaguugcauagucacaaaagugaucauuggaaacugug

SEQ ID NO: 75 - RNA, 84 nt, Homo sapiens
gugguacuugaagauagguuauccguguugccuucgcuuuauuugugacgaaucauacacgguugaccuauuuuucaguaccaa

SEQ ID NO: 76 - RNA, 65 nt, Homo sapiens
cuguuaaugcuaaucgugauagggguuuuugccuccaacugacuccuacauauuagcauuaacag

SEQ ID NO: 77 - RNA, 83 nt, Homo sapiens
ccuuggaguaaaguagcagcacauaaugguuuguggauuuugaaaaggugcaggccauauugugcugccucaaaaauacaagg

SEQ ID NO: 78 - RNA, 98 nt, Homo sapiens
uugaggccuuaaaguacuguagcagcacaucaugguuuacaugcuacagucaagaugcgaaucauuauuugcugcucuagaaauuuaaggaaauucau

SEQ ID NO: 79 - RNA, 89 nt, Homo sapiens
gucagcagugccuuagcagcacguaaauauuggcguuaagauucuaaaauuaucuccaguauuaacugugcugcugaaguaagguugac

SEQ ID NO: 80 - RNA, 81 nt, Homo sapiens
guuccacucuagcagcacguaaauauuggcguagugaaauauauauuaaacaccaauauuacugugcugcuuuagugugac

SEQ ID NO: 81 - RNA, 84 nt, Homo sapiens
gucagaauaaugucaaagugcuuacagugcagguagugauaugugcaucuacugcagugaaggcacuuguagcauuauggugac

SEQ ID NO: 82 - RNA, 110 nt, Homo sapiens
ugaguuuugagguugcuucagugaacauucaacgcugucggugaguuuggaauuaaaaucaaaaccaucgaccguugauuguacccuauggcuaaccaucaucuacucca

SEQ ID NO: 83 - RNA, 110 nt, Homo sapiens
agaagggcuaucaggccagccuucagaggacuccaaggaacauucaacgcugucggugaguuugggauuugaaaaaaccacugaccguugacuguaccuugggguccuua

SEQ ID NO: 84 - RNA, 110 nt, Homo sapiens
ccugugcagagauuauuuuuuaaaaggucacaaucaacauucauugcugucgguggguugaacuguguggacaagcucacugaacaaugaaugcaacuguggccccgcuu

SEQ ID NO: 85 - RNA, 89 nt, Homo sapiens
cugauggcugcacucaacauucauugcugucgguggguuugagucugaaucaacucacugaucaaugaaugcaaacugcggaccaaaca

SEQ ID NO: 86 - RNA, 110 nt, Homo sapiens
cggaaaauuugccaaggguuugggggaacauucaaccugucggugaguuugggcagcucaggcaaaccaucgaccguugaguggacccugaggccuggaauugccauccu

SEQ ID NO: 87 - RNA, 137 nt, Homo sapiens
guccccuccccuaggccacagccgaggucacaaucaacauucauuguugucgguggguugugaggacugaggccagacccaccgggggaugaaugucacuguggcugggccagacacggcuuaaggggaauggggac

SEQ ID NO: 88 - RNA, 110 nt, Homo sapiens
gagcugcuugccuccccccguuuuuggcaaugguagaacucacacuggugagguaacaggauccggugguucuagacuugccaacuauggggcgaggacucagccggcac

SEQ ID NO: 89 - RNA, 110 nt, Homo sapiens
ccgcagagugugacuccuguucuguguauggcacugguagaauucacugugaacagucucagucagugaauuaccgaagggccauaaacagagcagagacagauccacga

SEQ ID NO: 90 - RNA, 84 nt, Homo sapiens
ccagucacguccccuuaucacuuuuccagcccagcuuugugacuguaaguguuggacggagaacugauaaggguaggugauuga

SEQ ID NO: 91 - RNA, 82 nt, Homo sapiens
agggggcgagggauuggagagaaaggcaguuccugaugguccccuccccaggggcuggcuuuccucugguccuucccuccca

SEQ ID NO: 92 - RNA, 86 nt, Homo sapiens
ugcuuguaacuuuccaaagaauucuccuuuugggcuuucugguuuuauuuuaagcccaaaggugaauuuuuugggaaguuugagcu

SEQ ID NO: 93 - RNA, 109 nt, Homo sapiens
ggucgggcucaccaugacacagugugagaccucgggcuacaacacaggacccgggcgcugcucugaccccucgugucuuguguugcagccggagggacgcagguccgca

SEQ ID NO: 94 - RNA, 86 nt, Homo sapiens
ugcucccucucucacaucccuugcaugguggagggugagcuuucugaaaaccccucccacaugcaggguuugcaggauggcgagcc

SEQ ID NO: 95 - RNA, 71 nt, Homo sapiens
uguucuaaggugcaucuagugcagauagugaaguagauuagcaucuacugcccuaagugcuccuucuggca

SEQ ID NO: 96 - RNA, 71 nt, Homo sapiens
uguguuaaggugcaucuagugcaguuagugaagcagcuuagaaucuacugcccuaaaugccccuucuggca

SEQ ID NO: 97 - RNA, 85 nt, Homo sapiens
ugcaggccucugugugauauguuugauauauuagguuguuauuuaauccaacuauauaucaaacauauuccuacagugucuugcc

SEQ ID NO: 98 - RNA, 79 nt, Homo sapiens
ugcuucugugugauauguuugauauuggguuguuuaauuaggaaccaacuaaaugucaaacauauucuuacagcagcag

SEQ ID NO: 99 - RNA, 92 nt, Homo sapiens
cggcuggacagcgggcaacggaaucccaaaagcagcuguugucuccagagcauuccagcugcgcuuggauuucguccccugcucuccugccu

SEQ ID NO: 100 - RNA, 110 nt, Homo sapiens
gccgagaccgagugcacagggcucugaccuaugaauugacagccagugcucucgucuccccucuggcugccaauuccauaggucacagguauguucgccucaaugccagc

SEQ ID NO: 101 - RNA, 88 nt, Homo sapiens
cgaggaugggagcugagggcugggucuuugcgggcgagaugagggugucggaucaacuggccuacaaagucccaguucucggcccccg

SEQ ID NO: 102 - RNA, 83 nt, Homo sapiens
guggucucagaaucgggguuuugagggcgagaugaguuuauguuuuauccaacuggcccucaaagucccgcuuuuggggucau

SEQ ID NO: 103 - RNA, 85 nt, Homo sapiens
augguguuaucaaguguaacagcaacuccauguggacuguguaccaauuuccaguggagaugcuguuacuuuugaugguuaccaa

SEQ ID NO: 104 - RNA, 85 nt, Homo sapiens
ugguucccgcccccuguaacagcaacuccauguggaagugcccacugguuccaguggggcugcuguuaucuggggcgagggccag

SEQ ID NO: 105 - RNA, 87 nt, Homo sapiens
agcuucccuggcucuagcagcacagaaauauuggcacagggaagcgagucugccaauauuggcugugcugcuccaggcaggguggug

SEQ ID NO: 106 - RNA, 70 nt, Homo sapiens
gugaauuagguaguuucauguuguugggccuggguuucugaacacaacaacauuaaaccacccgauucac

SEQ ID NO: 107 - RNA, 110 nt, Homo sapiens
ugcucgcucagcugaucuguggcuuagguaguuucauguuguugggauugaguuuugaacucggcaacaagaaacugccugaguuacaucagucgguuuucgucgagggc

SEQ ID NO: 108 - RNA, 84 nt, Homo sapiens
acuggucggugauuuagguaguuuccuguuguugggauccaccuuucucucgacagcacgacacugccuucauuacuucaguug

SEQ ID NO: 109 - RNA, 75 nt, Homo sapiens
ggcugugccggguagagagggcagugggagguaagagcucuucacccuucaccaccuucuccacccagcauggcc

SEQ ID NO: 110 - RNA, 62 nt, Homo sapiens
ucauugguccagaggggagauagguuccugugauuuuuccuucuucucuauagaauaaauga

SEQ ID NO: 111 - RNA, 71 nt, Homo sapiens
gccaacccaguguucagacuaccuguucaggaggcucucaauguguacaguagucugcacauugguuaggc

SEQ ID NO: 112 - RNA, 110 nt, Homo sapiens
aggaagcuucuggagauccugcuccgucgccccaguguucagacuaccuguucaggacaaugccguuguacaguagucugcacauugguuagacugggcaagggagagca

SEQ ID NO: 113 - RNA, 110 nt, Homo sapiens
ccagaggacaccuccacuccgucuacccaguguuuagacuaucuguucaggacucccaaauuguacaguagucugcacauugguuaggcugggcuggguuagacccucgg

SEQ ID NO: 114 - RNA, 82 nt, Homo sapiens
gcaguccucuguuaguuuugcauaguugcacuacaagaagaauguaguugugcaaaucuaugcaaaacugaugguggccugc

SEQ ID NO: 115 - RNA, 87 nt, Homo sapiens
cacuguucuaugguuaguuuugcagguuugcauccagcugugugauauucugcugugcaaauccaugcaaaacugacugugguagug

SEQ ID NO: 116 - RNA, 96 nt, Homo sapiens
acauugcuacuuacaauuaguuuugcagguuugcauuucagcguauauauguauauguggcugugcaaauccaugcaaaacugauugugauaaugu

SEQ ID NO: 117 - RNA, 90 nt, Homo sapiens
ccgggccccugugagcaucuuaccggacagugcuggauuucccagcuugacucuaacacugucugguaacgauguucaaaggugacccgc

SEQ ID NO: 118 - RNA, 95 nt, Homo sapiens
ccagcucgggcagccguggccaucuuacugggcagcauuggauggagucaggucucuaauacugccugguaaugaugacggcggagcccugcacg

SEQ ID NO: 119 - RNA, 68 nt, Homo sapiens
cccucgucuuacccagcaguguuugggugcgguugggagucucuaauacugccggguaaugauggagg

SEQ ID NO: 120 - RNA, 110 nt, Homo sapiens
cgccucagagccgcccgccguuccuuuuuccuaugcauauacuucuuugaggaucuggccuaaagagguauagggcaugggaaaacggggcggucggguccuccccagcg

SEQ ID NO: 121 - RNA, 110 nt, Homo sapiens
guguuggggacucgcgcgcuggguccagugguucuuaacaguucaacaguucuguagcgcaauugugaaauguuuaggaccacuagacccggcgggcgcggcgacagcga

SEQ ID NO: 122 - RNA, 86 nt, Homo sapiens
gcgcccgccgggucuagugguccuaaacauuucacaauugcgcuacagaacuguugaacuguuaagaaccacuggacccagcgcgc

SEQ ID NO: 123 - RNA, 110 nt, Homo sapiens
ggcuacagucuuucuucaugugacucguggacuucccuuugucauccuaugccugagaauauaugaaggaggcugggaaggcaaagggacguucaauugucaucacuggc

SEQ ID NO: 124 - RNA, 110 nt, Homo sapiens
aaagauccucagacaauccaugugcuucucuuguccuucauuccaccggagucugucucauacccaaccagauuucaguggagugaaguucaggaggcauggagcugaca

SEQ ID NO: 125 - RNA, 86 nt, Homo sapiens
ugcuucccgaggccacaugcuucuuuauauccccauauggauuacuuugcuauggaauguaaggaagugugugguuucggcaagug

SEQ ID NO: 126 - RNA, 71 nt, Homo sapiens
ugacgggcgagcuuuuggcccggguuauaccugaugcucacguauaagacgagcaaaaagcuuguugguca

SEQ ID NO: 127 - RNA, 77 nt, Homo sapiens
ccucucagggaagcuuuuugcucgaauuauguuucugauccgaauauaagacgaacaaaagguuugucugagggcag

SEQ ID NO: 128 - RNA, 71 nt, Homo sapiens
guagcacuaaagugcuuauagugcagguaguguuuaguuaucuacugcauuaugagcacuuaaaguacugc

SEQ ID NO: 129 - RNA, 69 nt, Homo sapiens
aguaccaaagugcucauagugcagguaguuuuggcaugacucuacuguaguaugggcacuuccaguacu

SEQ ID NO: 130 - RNA, 72 nt, Homo sapiens
ugucggguagcuuaucagacugauguugacuguugaaucucauggcaacaccagucgaugggcugucugaca

SEQ ID NO: 131 - RNA, 110 nt, Homo sapiens
acccggcagugccuccaggcgcagggcagccccugcccaccgcacacugcgcugccccagacccacugugcgugugacagcggcugaucugugccugggcagcgcgaccc

SEQ ID NO: 132 - RNA, 110 nt, Homo sapiens
ucaccuggccaugugacuugugggcuucccuuugucauccuucgccuagggcucugagcagggcagggacagcaaaggggugcucaguugucacuucccacagcacggag

SEQ ID NO: 133 - RNA, 110 nt, Homo sapiens
cggggcaccccgcccggacagcgcgccggcaccuuggcucuagacugcuuacugcccgggccgcccucaguaacagucuccagucacggccaccgacgccuggccccgcc

SEQ ID NO: 134 - RNA, 110 nt, Homo sapiens
ggccuggcuggacagaguugucaugugucugccugucuacacuugcugugcagaacauccgcucaccuguacagcaggcacagacaggcagucacaugacaacccagccu

SEQ ID NO: 135 - RNA, 110 nt, Homo sapiens
aucauucagaaaugguauacaggaaaaugaccuaugaauugacagacaauauagcugaguuugucugucauuucuuuaggccaauauucuguaugacugugcuacuucaa

SEQ ID NO: 136 - RNA, 110 nt, Homo sapiens
gauggcugugaguuggcuuaaucucagcuggcaacugugagauguucauacaaucccucacaguggucucugggauuaugcuaaacagagcaauuuccuagcccucacga

SEQ ID NO: 137 - RNA, 82 nt, Homo sapiens
gcagacuggaaaaucucugcaggcaaaugugaugucacugaggaaaucacacacuuacccguagagauucuacagucugaca

SEQ ID NO: 138 - RNA, 110 nt, Homo sapiens
aguauaauuauuacauaguuuuugaugucgcagauacugcaucaggaacugauuggauaagaaucagucaccaucaguuccuaaugcauugccuucagcaucuaaacaag

SEQ ID NO: 139 - RNA, 110 nt, Homo sapiens
gugauaauguagcgagauuuucuguugugcuugaucuaaccaugugguugcgagguaugaguaaaacaugguuccgucaagcaccauggaacgucacgcagcuuucuaca

SEQ ID NO: 140 - RNA, 110 nt, Homo sapiens
gaccagucgcugcggggcuuuccuuugugcuugaucuaaccaugugguggaacgauggaaacggaacaugguucugucaagcaccgcggaaagcaccgugcucuccugca

SEQ ID NO: 141 - RNA, 110 nt, Homo sapiens
ccgccccgggccgcggcuccugauuguccaaacgcaauucucgagucuauggcuccggccgagaguugagucuggacgucccgagccgccgcccccaaaccucgagcggg

SEQ ID NO: 142 - RNA, 97 nt, Homo sapiens
acucaggggcuucgccacugauuguccaaacgcaauucuuguacgagucugcggccaaccgagaauuguggcuggacaucuguggcugagcuccggg

SEQ ID NO: 143 - RNA, 88 nt, Homo sapiens
ggagcucagccacagauguccagccacaauucucgguuggccgcagacucguacaagaauugcguuuggacaaucaguggcgaagccc

SEQ ID NO: 144 - RNA, 85 nt, Homo sapiens
ggcugagccgcaguaguucuucaguggcaagcuuuauguccugacccagcuaaagcugccaguugaagaacuguugcccucugcc

SEQ ID NO: 145 - RNA, 110 nt, Homo sapiens
ugaacauccaggucuggggcaugaaccuggcauacaauguagauuucuguguucguuaggcaacagcuacauugucugcuggguuucaggcuaccuggaaacauguucuc

SEQ ID NO: 146 - RNA, 110 nt, Homo sapiens
gcugcuggaagguguagguacccucaauggcucaguagccaguguagauccugucuuucguaaucagcagcuacaucuggcuacugggucucugauggcaucuucuagcu

SEQ ID NO: 147 - RNA, 110 nt, Homo sapiens
ccuggccuccugcagugccacgcuccguguauuugacaagcugaguuggacacuccaugugguagagugucaguuugucaaauaccccaagugcggcacaugcuuaccag

SEQ ID NO: 148 - RNA, 81 nt, Homo sapiens
gggcuuucaagucacuagugguuccguuuaguagaugauugugcauuguuucaaaauggugcccuagugacuacaaagccc

SEQ ID NO: 149 - RNA, 73 nt, Homo sapiens
ggccggcugggguuccuggggaugggauuugcuuccugucacaaaucacauugccagggauuuccaaccgacc

SEQ ID NO: 150 - RNA, 97 nt, Homo sapiens
cucaggugcucuggcugcuuggguuccuggcaugcugauuugugacuuaagauuaaaaucacauugccagggauuaccacgcaaccacgaccuuggc

SEQ ID NO: 151 - RNA, 100 nt, Homo sapiens
agugacuuuccaggugucacacagugaguggcauaaucagaguacaauuugagucaugcccauacaucacauugccagugauuacccaaggaaagugacg

SEQ ID NO: 152 - RNA, 68 nt, Homo sapiens
cuccggugccuacugagcugauaucaguucucauuuuacacacuggcucaguucagcaggaacaggag

SEQ ID NO: 153 - RNA, 73 nt, Homo sapiens
cucugccucccgugccuacugagcugaaacacaguugguuuguguacacuggcucaguucagcaggaacaggg

SEQ ID NO: 154 - RNA, 84 nt, Homo sapiens
ggccaguguugagaggcggagacuugggcaauugcuggacgcugcccugggcauugcacuugucucggucugacagugccggcc

SEQ ID NO: 155 - RNA, 77 nt, Homo sapiens
guggccucguucaaguaauccaggauaggcugugcaggucccaaugggccuauucuugguuacuugcacggggacgc

SEQ ID NO: 156 - RNA, 84 nt, Homo sapiens
ggcuguggcuggauucaaguaauccaggauaggcuguuuccaucugugaggccuauucuugauuacuuguuucuggaggcagcu

SEQ ID NO: 157 - RNA, 77 nt, Homo sapiens
ccgggacccaguucaaguaauucaggauagguugugugcuguccagccuguucuccauuacuuggcucggggaccgg

SEQ ID NO: 158 - RNA, 78 nt, Homo sapiens
cugaggagcagggcuuagcugcuugugagcaggguccacaccaagucguguucacaguggcuaaguuccgccccccag

SEQ ID NO: 159 - RNA, 97 nt, Homo sapiens
accucucuaacaaggugcagagcuuagcugauuggugaacagugauugguuuccgcuuuguucacaguggcuaaguucugcaccugaagagaaggug

SEQ ID NO: 160 - RNA, 86 nt, Homo sapiens
gguccuugcccucaaggagcucacagucuauugaguuaccuuucugacuuucccacuagauugugagcuccuggagggcaggcacu

SEQ ID NO: 161 - RNA, 80 nt, Homo sapiens
aggacccuuccagagggcccccccucaauccuguugugccuaauucagaggguuggguggaggcucuccugaagggcucu

SEQ ID NO: 162 - RNA, 66 nt, Homo sapiens
uguauguaugugugcaugugcauguauguguauauacauauauauguauuauguacucauauauca

SEQ ID NO: 163 - RNA, 88 nt, Homo sapiens
ucaggucuucagcagaagcagggagguucucccagugguuuuccuugacugugaggaacuagccugcugcuuugcucaggagugagcu

SEQ ID NO: 164 - RNA, 63 nt, Homo sapiens
aagaaaugguuuaccgucccacauacauuuugaauauguaugugggaugguaaaccgcuucuu

SEQ ID NO: 165 - RNA, 64 nt, Homo sapiens
augacugauuucuuuugguguucagagucaauauaauuuucuagcaccaucugaaaucgguuau

SEQ ID NO: 166 - RNA, 81 nt, Homo sapiens
cuucaggaagcugguuucauauggugguuuagauuuaaauagugauugucuagcaccauuugaaaucaguguucuuggggg

SEQ ID NO: 167 - RNA, 81 nt, Homo sapiens
cuucuggaagcugguuucacaugguggcuuagauuuuuccaucuuuguaucuagcaccauuugaaaucaguguuuuaggag

SEQ ID NO: 168 - RNA, 88 nt, Homo sapiens
aucucuuacacaggcugaccgauuucuccugguguucagagucuguuuuugucuagcaccauuugaaaucgguuaugauguaggggga

SEQ ID NO: 169 - RNA, 83 nt, Homo sapiens
ugcuacuugaagagagguaauccuucacgcauuugcuuuacuugcaaugauuauacaagggcagacucucucuggggagcaaa

SEQ ID NO: 170 - RNA, 86 nt, Homo sapiens
acugcuaacgaaugcucugacuuuauugcacuacuguacuuuacagcuagcagugcaauaguauugucaaagcaucugaaagcagg

SEQ ID NO: 171 - RNA, 78 nt, Homo sapiens
gccgcaggugcucugacgagguugcacuacugugcucugagaagcagugcaaugauauugucaaagcaucugggacca

SEQ ID NO: 172 - RNA, 69 nt, Homo sapiens
ccaccacuuaaacguggauguacuugcuuugaaacuaaagaaguaagugcuuccauguuuuggugaugg

SEQ ID NO: 173 - RNA, 73 nt, Homo sapiens
gcucccuucaacuuuaacauggaagugcuuucugugacuuuaaaaguaagugcuuccauguuuuaguaggagu

SEQ ID NO: 174 - RNA, 68 nt, Homo sapiens
ccuuugcuuuaacauggggguaccugcugugugaaacaaaaguaagugcuuccauguuucaguggagg

SEQ ID NO: 175 - RNA, 68 nt, Homo sapiens
ccucuacuuuaacauggaggcacuugcugugacaugacaaaaauaagugcuuccauguuugagugugg

SEQ ID NO: 176 - RNA, 72 nt, Homo sapiens
uuggguaagugcuuccaugcuucaguuuccuuacugguaagauggauguaguaauagcaccuaccuuauaga

SEQ ID NO: 177 - RNA, 51 nt, Homo sapiens
ucuguguaaaccuggcaauuuucacuuaauugcuuccauguuuauaaaaga

SEQ ID NO: 178 - RNA, 71 nt, Homo sapiens
gcgacuguaaacauccucgacuggaagcugugaagccacagaugggcuuucagucggauguuugcagcugc

SEQ ID NO: 179 - RNA, 88 nt, Homo sapiens
accaaguuucaguucauguaaacauccuacacucagcuguaauacauggauuggcugggagguggauguuuacuucagcugacuugga

SEQ ID NO: 180 - RNA, 89 nt, Homo sapiens
accaugcuguaguguguguaaacauccuacacucucagcugugagcucaagguggcugggagaggguuguuuacuccuucugccaugga

SEQ ID NO: 181 - RNA, 72 nt, Homo sapiens
agauacuguaaacauccuacacucucagcuguggaaaguaagaaagcugggagaaggcuguuuacucuuucu

SEQ ID NO: 182 - RNA, 70 nt, Homo sapiens
guuguuguaaacauccccgacuggaagcuguaagacacagcuaagcuuucagucagauguuugcugcuac

SEQ ID NO: 183 - RNA, 92 nt, Homo sapiens
gggcagucuuugcuacuguaaacauccuugacuggaagcuguaagguguucagaggagcuuucagucggauguuuacagcggcaggcugcca

SEQ ID NO: 184 - RNA, 71 nt, Homo sapiens
ggagaggaggcaagaugcuggcauagcuguugaacugggaaccugcuaugccaacauauugccaucuuucc

SEQ ID NO: 185 - RNA, 70 nt, Homo sapiens
ggagauauugcacauuacuaaguugcauguugucacggccucaaugcaauuuagugugugugauauuuuc

SEQ ID NO: 186 - RNA, 82 nt, Homo sapiens
gcuucgcuccccuccgccuucucuucccgguucuucccggagucgggaaaagcuggguugagagggcgaaaaaggaugaggu

SEQ ID NO: 187 - RNA, 79 nt, Homo sapiens
aauuaaucccucucuuucuaguucuuccuagagugaggaaaagcuggguugagagggcaaacaaauuaacuaauuaauu

SEQ ID NO: 188 - RNA, 138 nt, Homo sapiens
uguuauuuuuugucuucuaccuaagaauucugucucuuaggcuuucucuucccagauuucccaaaguugggaaaagcuggguugagagggcaaaaggaaaaaaaaagaauucugucucugacauaauuagauagggaa

SEQ ID NO: 189 - RNA, 88 nt, Homo sapiens
uuugcauuaaaaaugaggccuucucuucccaguucuucccagagucaggaaaagcuggguugagaggguagaaaaaaaaugauguagg

SEQ ID NO: 190 - RNA, 50 nt, Homo sapiens
cuucucuuuccaguucuucccagaauugggaaaagcuggguugagagggu

SEQ ID NO: 191 - RNA, 48 nt, Homo sapiens
uucucgucccaguucuucccaaaguugagaaaagcuggguugagagga

SEQ ID NO: 192 - RNA, 48 nt, Homo sapiens
uucucuucccaguucuucuuggagucaggaaaagcuggguugagagga

SEQ ID NO: 193 - RNA, 53 nt, Homo sapiens
gccuucucuucccaguucuuccuggagucggggaaaagcuggguugagaaggu

SEQ ID NO: 194 - RNA, 86 nt, Homo sapiens
uugguacuuggagagaggugguccguggcgcguucgcuuuauuuauggcgcacauuacacggucgaccucuuugcaguaucuaauc

SEQ ID NO: 195 - RNA, 82 nt, Homo sapiens
ugguacucggagggagguuguccguggugaguucgcauuauuuaaugaugcccaauacacggucgaccucuuuucgguauca

SEQ ID NO: 196 - RNA, 83 nt, Homo sapiens
cugacuaugccuccccgcauccccuagggcauugguguaaagcuggagacccacugccccaggugcugcuggggguuguaguc

SEQ ID NO: 197 - RNA, 98 nt, Homo sapiens
auacagugcuugguuccuaguagguguccaguaaguguuugugacauaauuuguuuauugaggaccuccuaucaaucaagcacugugcuaggcucugg

SEQ ID NO: 198 - RNA, 95 nt, Homo sapiens
cucaucugucuguugggcuggaggcagggccuuugugaaggcggguggugcucagaucgccucugggcccuuccuccagccccgaggcggauuca

SEQ ID NO: 199 - RNA, 75 nt, Homo sapiens
uggagugggggggcaggaggggcucagggagaaagugcauacagccccuggcccucucugcccuuccguccccug

SEQ ID NO: 200 - RNA, 80 nt, Homo sapiens
gguaccugaagagagguuuucuggguuucuguuucuuuaaugaggacgaaacacaccugguuaaccucuuuuccaguauc

SEQ ID NO: 201 - RNA, 84 nt, Homo sapiens
gugguaccugaagagagguuuucuggguuucuguuucuuuauugaggacgaaacacaccugguuaaccucuuuuccaguaucaa

SEQ ID NO: 202 - RNA, 94 nt, Homo sapiens
cuuuggcgaucacugccucucugggccugugucuuaggcucugcaagaucaaccgagcaaagcacacggccugcagagaggcagcgcucugccc

SEQ ID NO: 203 - RNA, 94 nt, Homo sapiens
gaguuugguuuuguuuggguuuguucuagguauggucccagggaucccagaucaaaccaggccccugggccuauccuagaaccaaccuaagcuc

SEQ ID NO: 204 - RNA, 94 nt, Homo sapiens
uguuuugagcgggggucaagagcaauaacgaaaaauguuugucauaaaccguuuuucauuauugcuccugaccuccucucauuugcuauauuca

SEQ ID NO: 205 - RNA, 93 nt, Homo sapiens
guagucaguaguuggggggugggaacggcuucauacaggaguugaugcacaguuauccagcuccuauaugaugccuuucuucauccccuucaa

SEQ ID NO: 206 - RNA, 67 nt, Homo sapiens
ucuccaacaauauccuggugcugagugaugacucaggcgacuccagcaucagugauuuuguugaaga

SEQ ID NO: 207 - RNA, 94 nt, Homo sapiens
cggggcggccgcucucccuguccuccaggagcucacgugugccugccugugagcgccucgacgacagagccggcgccugccccagugucugcgc

SEQ ID NO: 208 - RNA, 69 nt, Homo sapiens
cuguggugcauuguaguugcauugcauguucuggugguacccaugcaauguuuccacagugcaucacag

SEQ ID NO: 209 - RNA, 96 nt, Homo sapiens
gcgggcggccccgcggugcauugcuguugcauugcacgugugugaggcgggugcagugccucggcagugcagcccggagccggccccuggcaccac

SEQ ID NO: 210 - RNA, 95 nt, Homo sapiens
uuguaccuggugugauuauaaagcaaugagacugauugucauaugucguuugugggauccgucucaguuacuuuauagccauaccugguaucuua

SEQ ID NO: 211 - RNA, 99 nt, Homo sapiens
gaaacugggcucaaggugaggggugcuaucugugauugagggacaugguuaauggaauugucucacacagaaaucgcacccgucaccuuggccuacuua

SEQ ID NO: 212 - RNA, 98 nt, Homo sapiens
acccaaacccuaggucugcugacuccuaguccagggcucgugauggcuggugggcccugaacgaggggucuggaggccuggguuugaauaucgacagc

SEQ ID NO: 213 - RNA, 95 nt, Homo sapiens
ggucucuguguugggcgucugucugcccgcaugccugccucucuguugcucugaaggaggcaggggcugggccugcagcugccugggcagagcgg

SEQ ID NO: 214 - RNA, 110 nt, Homo sapiens
ggccagcugugaguguuucuuuggcagugucuuagcugguuguugugagcaauaguaaggaagcaaucagcaaguauacugcccuagaagugcugcacguuguggggccc

SEQ ID NO: 215 - RNA, 84 nt, Homo sapiens
gugcucgguuuguaggcagugucauuagcugauuguacuguggugguuacaaucacuaacuccacugccaucaaaacaaggcac

SEQ ID NO: 216 - RNA, 77 nt, Homo sapiens
agucuaguuacuaggcaguguaguuagcugauugcuaauaguaccaaucacuaaccacacggccagguaaaaagauu

SEQ ID NO: 217 - RNA, 72 nt, Homo sapiens
ggagcuuaucagaaucuccagggguacuuuauaauuucaaaaagucccccaggugugauucugauuugcuuc

SEQ ID NO: 218 - RNA, 65 nt, Homo sapiens
cuugaauccuuggaaccuaggugugagugcuauuucagugcaacacaccuauucaaggauucaaa

SEQ ID NO: 219 - RNA, 75 nt, Homo sapiens
uguugucggguggaucacgaugcaauuuugaugaguaucauaggagaaaaauugcacgguauccaucuguaaacc

SEQ ID NO: 220 - RNA, 87 nt, Homo sapiens
accgcagggaaaaugagggacuuuugggggcagauguguuuccauuccacuaucauaaugccccuaaaaauccuuauugcucuugca

SEQ ID NO: 221 - RNA, 111 nt, Homo sapiens
agaguguucaaggacagcaagaaaaaugagggacuuucaggggcagcuguguuuucugacucagucauaaugccccuaaaaauccuuauuguucuugcagugugcaucggg

SEQ ID NO: 222 - RNA, 68 nt, Homo sapiens
ccauuacuguugcuaauaugcaacucuguugaauauaaauuggaauugcacuuuagcaauggugaugg

SEQ ID NO: 223 - RNA, 70 nt, Homo sapiens
uugaagggagaucgaccguguuauauucgcuuuauugacuucgaauaauacaugguugaucuuuucucag

SEQ ID NO: 224 - RNA, 75 nt, Homo sapiens
agacagagaagccaggucacgucucugcaguuacacagcucacgagugccugcugggguggaaccuggucugucu

SEQ ID NO: 225 - RNA, 67 nt, Homo sapiens
guggcacucaaacugugggggcacuuucugcucucuggugaaagugccgccaucuuuugaguguuac

SEQ ID NO: 226 - RNA, 66 nt, Homo sapiens
gguaacacucaaaagauggcggcacuuucaccagagagcagaaagugcccccacaguuugagugcc

SEQ ID NO: 227 - RNA, 67 nt, Homo sapiens
gugggccucaaauguggagcacuauucugauguccaaguggaaagugcugcgacauuugagcgucac

SEQ ID NO: 228 - RNA, 69 nt, Homo sapiens
gggauacucaaaaugggggcgcuuuccuuuuugucuguacugggaagugcuucgauuuugggguguccc

SEQ ID NO: 229 - RNA, 72 nt, Homo sapiens
uacaucggccauuauaauacaaccugauaaguguuauagcacuuaucagauuguauuguaauugucugugua

SEQ ID NO: 230 - RNA, 72 nt, Homo sapiens
acucggauggauauaauacaaccugcuaaguguccuagcacuuagcagguuguauuaucauuguccgugucu

SEQ ID NO: 231 - RNA, 70 nt, Homo sapiens
acacggacaaugauaauacaaccugcuaagugcuaggacacuuagcagguuguauuauauccauccgagu

SEQ ID NO: 232 - RNA, 64 nt, Homo sapiens
ccccgcgacgagccccucgcacaaaccggaccugagcguuuuguucguucggcucgcgugaggc

SEQ ID NO: 233 - RNA, 68 nt, Homo sapiens
uaaaagguagauucuccuucuaugaguacauuauuuaugauuaaucauagaggaaaauccacguuuuc

SEQ ID NO: 234 - RNA, 80 nt, Homo sapiens
gguauuuaaaagguagauuuuccuucuaugguuacguguuugaugguuaaucauagaggaaaauccacguuuucaguauc

SEQ ID NO: 235 - RNA, 100 nt, Homo sapiens
caguccuucuuugguauuuaaaacguggauauuccuucuauguuuacgugauuccugguuaaucauagaggaaaauccauguuuucaguaucaaaugcug

SEQ ID NO: 236 - RNA, 66 nt, Homo sapiens
aaaagguggauauuccuucuauguuuauguuauuuaugguuaaacauagaggaaauuccacguuuu

SEQ ID NO: 237 - RNA, 69 nt, Homo sapiens
uugagcagagguugcccuuggugaauucgcuuuauuuauguugaaucacacaaaggcaacuuuuguuug

SEQ ID NO: 238 - RNA, 66 nt, Homo sapiens
agggcuccugacuccagguccuguguguuaccuagaaauagcacuggacuuggagucagaaggccu

SEQ ID NO: 239 - RNA, 57 nt, Homo sapiens
ggucauugagucuucaaggcuaguggaaagagcacuggacuuggaggcagaaagacc

SEQ ID NO: 240 - RNA, 81 nt, Homo sapiens
ggaggccaucacuggacuuggagucagaagaguggagucgggucagacuucaacucugacuuugaagguggugagugccuc

SEQ ID NO: 241 - RNA, 54 nt, Homo sapiens
acuguuucuguccuuguucuuguuguuauuacuggacuuggagucagaaacagg

SEQ ID NO: 242 - RNA, 98 nt, Homo sapiens
gaaugguuacaaggagagaacacuggacuuggagucagaaaacuuucauccaagucauucccugcucuaagucccauuucuguuccaugagauuguuu

SEQ ID NO: 243 - RNA, 79 nt, Homo sapiens
cugacuccaguguccaggccaggggcagacaguggacagagaacagugcccaagaccacuggacuuggagucaggacau

SEQ ID NO: 244 - RNA, 78 nt, Homo sapiens
gucagguccuggacucccauaguuuucaggcugcuaaacaacagaacgagcacuggacuuggagccagaagucuuggg

SEQ ID NO: 245 - RNA, 41 nt, Homo sapiens
cacugggcuuggagucagaagaccuggcuccagcccagcuc

SEQ ID NO: 246 - RNA, 83 nt, Homo sapiens
acaggaacacuggacuuggugucagaugggaugagcccuggcucuguuuccuagcagcaaucugaucuugagcuagucacugg

SEQ ID NO: 247 - RNA, 76 nt, Homo sapiens
gggagcacuggacuaggagucagaagguggaguucugggugcuguuuucccacucuugggcccugggcauguucug

SEQ ID NO: 248 - RNA, 109 nt, Homo sapiens
augcagugagucggggaggaacuggauuuggagccagaagaacugguucuaauaucuacuucccuguguagaguugggauuugggauuauaugaguuaauauacaccaa

SEQ ID NO: 249 - RNA, 67 nt, Homo sapiens
agagaugguagacuauggaacguaggcguuaugauuucugaccuauguaacaugguccacuaacucu

SEQ ID NO: 250 - RNA, 61 nt, Homo sapiens
aagaugguugaccauagaacaugcgcuaucucugugucguauguaauaugguccacaucuu

SEQ ID NO: 251 - RNA, 75 nt, Homo sapiens
uacuuaaagcgagguugcccuuuguauauucgguuuauugacauggaauauacaagggcaagcucucugugagua

SEQ ID NO: 252 - RNA, 76 nt, Homo sapiens
uacuugaagagaaguuguucgugguggauucgcuuuacuuaugacgaaucauucacggacaacacuuuuuucagua

SEQ ID NO: 253 - RNA, 73 nt, Homo sapiens
cuccucagaucagaaggugauuguggcuuuggguggauauuaaucagccacagcacugccuggucagaaagag

SEQ ID NO: 254 - RNA, 88 nt, Homo sapiens
uguuaaaucaggaauuuuaaacaauuccuagacaauauguauaauguucauaagucauuccuagaaauuguucauaaugccuguaaca

SEQ ID NO: 255 - RNA, 79 nt, Homo sapiens
ugguacucggggagagguuacccgagcaacuuugcaucuggacgacgaauguugcucggugaaccccuuuucgguauca

SEQ ID NO: 256 - RNA, 80 nt, Homo sapiens
gguaccugagaagagguugucugugaugaguucgcuuuuauuaaugacgaauauaacacagauggccuguuuucaguacc

SEQ ID NO: 257 - RNA, 96 nt, Homo sapiens
ugguacuuggagagauaguagaccguauagcguacgcuuuaucugugacguauguaacacgguccacuaacccucaguaucaaauccauccccgag

SEQ ID NO: 258 - RNA, 91 nt, Homo sapiens
cugggguacggggauggauggucgaccaguuggaaaguaauuguuucuaauguacuucaccugguccacuagccguccguauccgcugcag

SEQ ID NO: 259 - RNA, 85 nt, Homo sapiens
gcacauuguaggccucauuaaauguuuguugaaugaaaaaaugaaucaucaacagacauuaauugggcgccugcucugugaucuc

SEQ ID NO: 260 - RNA, 90 nt, Homo sapiens
gagagaagcacuggacuuagggucagaaggccugagucucucugcugcagaugggcucucugucccugagccaagcuuuguccucccugg

SEQ ID NO: 261 - RNA, 94 nt, Homo sapiens
auaaaggaaguuaggcugaggggcagagagcgagacuuuucuauuuuccaaaagcucggucugaggccccucagucuugcuuccuaacccgcgc

SEQ ID NO: 262 - RNA, 98 nt, Homo sapiens
cgaggggauacagcagcaauucauguuuugaaguguucuaaaugguucaaaacgugaggcgcugcuauacccccucguggggaagguagaaggugggg

SEQ ID NO: 263 - RNA, 87 nt, Homo sapiens
gaaagcgcuuuggaaugacacgaucacucccguugagugggcacccgagaagccaucgggaaugucguguccgcccagugcucuuuc

SEQ ID NO: 264 - RNA, 83 nt, Homo sapiens
cgccggccgaugggcgucuuaccagacaugguuagaccuggcccucugucuaauacugucugguaaaaccguccauccgcugc

SEQ ID NO: 265 - RNA, 114 nt, Homo sapiens
uccugcuuguccugcgaggugucuugcaggccgucaugcaggccacacugacgguaacguugcaggucgucuugcagggcuucucgcaagacgacauccucaucaccaacgacg

SEQ ID NO: 266 - RNA, 94 nt, Homo sapiens
ugacuccuccaggucuuggaguaggucauuggguggauccucuauuuccuuacgugggccacuggauggcuccuccaugucuuggaguagauca

SEQ ID NO: 267 - RNA, 93 nt, Homo sapiens
ccggggagaaguacggugagccugucauuauucagagaggcuagauccucuguguugagaaggaucaugaugggcuccucgguguucuccagg

SEQ ID NO: 268 - RNA, 111 nt, Homo sapiens
gccgggagguugaacauccugcauagugcugccaggaaaucccuauuucauauaagagggggcuggcugguugcauauguaggaugucccaucucccagcccacuucguca

SEQ ID NO: 269 - RNA, 91 nt, Homo sapiens
cugugugugaugagcuggcaguguauuguuagcugguugaauaugugaauggcaucggcuaacaugcaacugcugucuuauugcauauaca

SEQ ID NO: 270 - RNA, 97 nt, Homo sapiens
ugaccugaaucagguaggcaguguauuguuagcuggcugcuugggucaagucagcagccacaacuacccugccacuugcuucuggauaaauucuucu

SEQ ID NO: 271 - RNA, 92 nt, Homo sapiens
gcugggaugugucagguaggcaguguauugcuagcggcuguuaaugauuuuaacaguugcuaguugcacuccucucuguugcauucagaagc

SEQ ID NO: 272 - RNA, 91 nt, Homo sapiens
aaacgauacuaaacuguuuuugcgauguguuccuaauaugcacuauaaauauauugggaacauuuugcauguauaguuuuguaucaauaua

SEQ ID NO: 273 - RNA, 100 nt, Homo sapiens
ccaaagaaagaugcuaaacuauuuuugcgauguguuccuaauauguaauauaaauguauuggggacauuuugcauucauaguuuuguaucaauaauaugg

SEQ ID NO: 274 - RNA, 78 nt, Homo sapiens
gcagaauuauuuuugcaauauguuccugaauauguaauauaaguguauugggaucauuuugcauccauaguuuuguau

SEQ ID NO: 275 - RNA, 72 nt, Homo sapiens
cuugggaauggcaaggaaaccguuaccauuacugaguuuaguaaugguaaugguucucuugcuauacccaga

SEQ ID NO: 276 - RNA, 68 nt, Homo sapiens
uggguauagcaagagaaccauuaccauuacuaaacucaguaaugguaacgguuuccuugccauuccca

SEQ ID NO: 277 - RNA, 110 nt, Homo sapiens
uuggauguuggccuaguucuguguggaagacuagugauuuuguuguuuuuagauaacuaaaucgacaacaaaucacagucugccauauggcacaggccaugccucuacag

SEQ ID NO: 278 - RNA, 110 nt, Homo sapiens
cuggauacagaguggaccggcuggccccaucuggaagacuagugauuuuguuguugucuuacugcgcucaacaacaaaucccagucuaccuaauggugccagccaucgca

SEQ ID NO: 279 - RNA, 110 nt, Homo sapiens
agauuagaguggcuguggucuagugcuguguggaagacuagugauuuuguuguucugauguacuacgacaacaagucacagccggccucauagcgcagacucccuucgac

SEQ ID NO: 280 - RNA, 89 nt, Homo sapiens
cgggguugguuguuaucuuugguuaucuagcuguaugagugguguggagucuucauaaagcuagauaaccgaaaguaaaaauaacccca

SEQ ID NO: 281 - RNA, 87 nt, Homo sapiens
ggaagcgaguuguuaucuuugguuaucuagcuguaugaguguauuggucuucauaaagcuagauaaccgaaaguaaaaacuccuuca

SEQ ID NO: 282 - RNA, 78 nt, Homo sapiens
cuuucuacacagguugggaucgguugcaaugcuguguuucuguaugguauugcacuugucccggccuguugaguuugg

SEQ ID NO: 283 - RNA, 75 nt, Homo sapiens
ucaucccuggguggggauuuguugcauuacuuguguucuauauaaaguauugcacuugucccggccuguggaaga

SEQ ID NO: 284 - RNA, 96 nt, Homo sapiens
cgggccccgggcgggcgggagggacgggacgcggugcaguguuguuuuuucccccgccaauauugcacucgucccggccuccggcccccccggccc

SEQ ID NO: 285 - RNA, 80 nt, Homo sapiens
cugggggcuccaaagugcuguucgugcagguagugugauuacccaaccuacugcugagcuagcacuucccgagcccccgg

SEQ ID NO: 286 - RNA, 90 nt, Homo sapiens
ggaggcccguuucucucuuugguuaucuagcuguaugagugccacagagccgucauaaagcuagauaaccgaaaguagaaaugauucuca

SEQ ID NO: 287 - RNA, 81 nt, Homo sapiens
aacacagugggcacucaauaaaugucuguugaauugaaaugcguuacauucaacggguauuuauugagcacccacucugug

SEQ ID NO: 288 - RNA, 78 nt, Homo sapiens
uggccgauuuuggcacuagcacauuuuugcuugugucucuccgcucugagcaaucaugugcagugccaauaugggaaa

SEQ ID NO: 289 - RNA, 119 nt, Homo sapiens
aggauucugcucaugccagggugagguaguaaguuguauuguugugggguagggauauuaggccccaauuagaagauaacuauacaacuuacuacuuucccugguguguggcauauuca

SEQ ID NO: 290 - RNA, 81 nt, Homo sapiens
cccauuggcauaaacccguagauccgaucuuguggugaaguggaccgcacaagcucgcuucuaugggucugugucagugug

SEQ ID NO: 291 - RNA, 70 nt, Homo sapiens
ggcacccacccguagaaccgaccuugcggggccuucgccgcacacaagcucgugucuguggguccguguc

SEQ ID NO: 292 - RNA, 85 nt, Homo sapiens
gcuaagcacuuacaacuguuugcagaggaaacugagacuuuguaacuaugucucagucucaucugcaaagaaguaagugcuuugc

SEQ ID NO: 293 - RNA, 115 nt, Homo sapiens
ucuguuuaucaccagauccuagaacccuaucaauauugucucugcuguguaaauaguucugaguagugcaauauugcuuauaggguuuugguguuuggaaagaacaaugggcagg

SEQ ID NO: 294 - RNA, 96 nt, Homo sapiens
ucccuggcgugaggguaugugccuuuggacuacaucguggaagccagcaccaugcaguccaugggcauauacacuugccucaaggccuaugucauc

SEQ ID NO: 295 - RNA, 84 nt, Homo sapiens
guguguguauauguguguugcauguguguauauguguguauauauguacacauacacauacacgcaacacacauauauacaugc

SEQ ID NO: 296 - RNA, 76 nt, Homo sapiens
gagggggaagacgggaggaaagaagggagugguuccaucacgccuccucacuccucuccucccgucuucuccucuc

SEQ ID NO: 297 - RNA, 79 nt, Homo sapiens
agccucgucaggcucaguccccucccgauaaaccccuaaauagggacuuucccggggggugacccuggcuuuuuuggcg

SEQ ID NO: 298 - RNA, 73 nt, Homo sapiens
acuuggagagaggcuggccgugaugaauucgauucaucaaagcgagucauacacggcucuccucucuuuuagu

SEQ ID NO: 299 - RNA, 68 nt, Homo sapiens
gcauccuguacugagcugccccgaggcccuucaugcugcccagcucggggcagcucaguacaggauac

SEQ ID NO: 300 - RNA, 64 nt, Homo sapiens
uccuguacugagcugccccgagcugggcagcaugaagggccucggggcagcucaguacaggaug

SEQ ID NO: 301 - RNA, 80 nt, Homo sapiens
gguacuugaagagugguuaucccugcuguguucgcuuaauuuaugacgaaucauacagggacauccaguuuuucaguauc

SEQ ID NO: 302 - RNA, 84 nt, Homo sapiens
uugguacuuggagagugguuaucccuguccuguucguuuugcucaugucgaaucguacagggucauccacuuuuucaguaucaa

SEQ ID NO: 303 - RNA, 83 nt, Homo sapiens
gagaaucaucucucccagauaauggcacucucaaacaaguuuccaaauuguuugaaaggcuauuucuuggucagaugacucuc

SEQ ID NO: 304 - RNA, 84 nt, Homo sapiens
guggcagcuugguggucguaugugugacgccauuuacuugaaccuuuaggagugacaucacauauacggcagcuaaacugcuac

SEQ ID NO: 305 - RNA, 128 nt, Homo sapiens
uggaggccuugcugguuuggaaaguucauuguucgacaccauggaucuccaggugggucaaguuuagagaugcaccaaccuggaggacuccaugcuguugagcuguucacaagcagcggacacuucca

SEQ ID NO: 306 - RNA, 84 nt, Homo sapiens
uugacuuagcuggguaguggggaacccuuccaugaggaguagaacacuccuuaugcaagauucccuucuaccuggcuggguugg

SEQ ID NO: 307 - RNA, 116 nt, Homo sapiens
caacuacagccacuacuacaggaccaucgaggaccugcgggacaagauucuuggugccaccauugagaacgccaggauuguccugcagaucaacaaugcucaacuggcugcagaug

SEQ ID NO: 308 - RNA, 89 nt, Homo sapiens
cuggccuccagggcuuuguacaugguaggcuuucauucauucguuugcacauucggugaaggucuacugugugccaggcccugugccag

SEQ ID NO: 309 - RNA, 81 nt, Homo sapiens
gauacucgaaggagagguuguccguguugucuucucuuuauuuaugaugaaacauacacgggaaaccucuuuuuuaguauc

SEQ ID NO: 310 - RNA, 82 nt, Homo sapiens
ugguaccugaaaagaaguugcccauguuauuuucgcuuuauaugugacgaaacaaacauggugcacuucuuuuucgguauca

SEQ ID NO: 311 - RNA, 102 nt, Homo sapiens
cccaagucagguacucgaauggagguuguccaugguguguucauuuuauuuaugaugaguauuacauggccaaucuccuuucgguacucaauucuucuuggg

SEQ ID NO: 312 - RNA, 112 nt, Homo sapiens
ccaccccgguccugcucccgccccagcagcacacugugguuuguacggcacuguggccacguccaaaccacacugugguguuagagcgagggugggggaggcaccgccgagg

SEQ ID NO: 313 - RNA, 124 nt, Homo sapiens
aacccuccuugggaagugaagcucaggcugugauuucaagccagggggcguuuuucuauaacuggaugaaaagcaccuccagagcuugaagcucacaguuugagagcaaucgucuaaggaaguu

SEQ ID NO: 314 - RNA, 122 nt, Homo sapiens
gcccuguccccugugccuugggcgggcggcuguuaagacuugcagugauguuuaacuccucuccacgugaacaucacagcaagucugugcugcuucccgucccuacgcugccugggcagggu

SEQ ID NO: 315 - RNA, 73 nt, Homo sapiens
ggaagcagcacagacuugcugugauguucacguggagaggaguuaaacaucacugcaagucuuaacagccgcc

SEQ ID NO: 316 - RNA, 84 nt, Homo sapiens
gcucccccucucuaauccuugcuaccugggugagagugcugucugaaugcaaugcaccugggcaaggauucugagagcgagagc

SEQ ID NO: 317 - RNA, 79 nt, Homo sapiens
cccccucucuaauccuugcuaccugggugagagugcuuucugaaugcagugcacccaggcaaggauucugcaaggggga

SEQ ID NO: 318 - RNA, 84 nt, Homo sapiens
gcucuuccucucuaauccuuugucccugggugagagugcuuucugaaugcaaugcacccgggcaaggauucugagagggugagc

SEQ ID NO: 319 - RNA, 86 nt, Homo sapiens
ugcucccccucucuaauccuugcuaucugggugcuagugcuggcucaaugcaaugcaccugggcaaggauucagagagggggagcu

SEQ ID NO: 320 - RNA, 71 nt, Homo sapiens
ugcccuagcagcgggaacaguucugcagugagcgaucggugcucugggguauuguuuccgcugccagggua

SEQ ID NO: 321 - RNA, 83 nt, Homo sapiens
gcugcuguugggagacccuggucugcacucuaucuguauucuuacugaagggagugcagggcaggguuucccauacagagggc

SEQ ID NO: 322 - RNA, 84 nt, Homo sapiens
gaugcacccagugggggagccaggaaguauugauguuucugccaguuuagcgucaacacuugcugguuuccucucuggagcauc

SEQ ID NO: 323 - RNA, 124 nt, Homo sapiens
gccaccaccaucagccauacuauguguagugccuuauucaggaagguguuacuuaauagauuaauauuuguaaggcacccuucugaguagaguaaugugcaacauggacaacauuugugguggc

SEQ ID NO: 324 - RNA, 94 nt, Homo sapiens
gugcuguguguagugcuucacuucaagaagugccaugcaugugucuagaaauauguuuugcaccuuuuggagugaaauaaugcacaacagauac

SEQ ID NO: 325 - RNA, 115 nt, Homo sapiens
ccaccuucagcugaguguagugcccuacuccagagggcgucacucauguaaacuaaaacaugauuguagccuuuuggaguagaguaauacacaucacguaacgcauauuuggugg

SEQ ID NO: 326 - RNA, 94 nt, Homo sapiens
caugcugugugugguacccuacugcagacaguggcaaucauguauaauuaaaaaugauugguacgucuguggguagaguacugcaugacacaug

SEQ ID NO: 327 - RNA, 91 nt, Homo sapiens
caugcugugugugguacccuacugcagacaguggcaaucauguauaauuaaaaaugauugguacgucuguggguagaguacugcaugacac

SEQ ID NO: 328 - RNA, 75 nt, Homo sapiens
gugguacccuacugcagacguggcaaucauguauaauuaaaaaugauugguacgucuguggguagaguacugcau

SEQ ID NO: 329 - RNA, 74 nt, Homo sapiens
gugguguccuacucaggagaguggcaaucacauguaauuaggugugauugaaaccucuaagaguggaguaacac

SEQ ID NO: 330 - RNA, 87 nt, Homo sapiens
caauagacacccaucgugucuuuugcucugcagucaguaaauauuuuuuugugaauguguagcaaaagacagaauggugguccauug

SEQ ID NO: 331 - RNA, 84 nt, Homo sapiens
ucucagucuguggcacucagccuugagggcacuuucuggugccagaaugaaagugcugucauagcugagguccaaugacugagg

SEQ ID NO: 332 - RNA, 98 nt, Homo sapiens
gguacuucucagucuguggcacucagccuugagggcacuuucuggugccagaaugaaagugcugucauagcugagguccaaugacugaggcgagcacc

SEQ ID NO: 333 - RNA, 129 nt, Homo sapiens
gggaugccacauucagccauucagcguacagugccuuucacagggaggugucauuuaugugaacuaaaauauaaauuucaccuuucugagaaggguaauguacagcaugcacugcauaugugguguccc

SEQ ID NO: 334 - RNA, 127 nt, Homo sapiens
ggaugccacauucagccauucagugugcagugccuuucacagggaggugucauuuaugugaacuaaaauauaaauuucaccuuucugagaaggguaauguacagcaugcacugcauauguggugucc

SEQ ID NO: 335 - RNA, 84 nt, Homo sapiens
guguacagugccuuucacaaggaggugucauuuaugugaacuaaaauauaaaugucaccuuuuugagaggaguaauguacagca

SEQ ID NO: 336 - RNA, 84 nt, Homo sapiens
gcguacagugccuuucucaaggaggugucguuuaugugaacuaaaauauaaauuucaccuuucugagaagaguaauguacagca

SEQ ID NO: 337 - RNA, 98 nt, Homo sapiens
aacauguugucugugguacccuacucuggagagugacaaucauguauaauuaaauuugauugacacuucugugaguagaguaacgcaugacacguacg

SEQ ID NO: 338 - RNA, 88 nt, Homo sapiens
guugucugugguacccuacucuggagagugacaaucauguauaacuaaauuugauugacacuucugugaguagaguaacgcaugacac

SEQ ID NO: 339 - RNA, 88 nt, Homo sapiens; identical to SEQ ID NO: 338

SEQ ID NO: 340 - RNA, 80 nt, Homo sapiens
caugugguacucuucucaagagggaggcaaucauguguaauuagauaugauugacaccucugugaguggaguaacacaug

SEQ ID NO: 341 - RNA, 83 nt, Homo sapiens
ucucaugcagucauucuccaaaagaaagcacuuucuguugucugaaagcagagugccuucuuuuggagcguuacuguuugaga

SEQ ID NO: 342 - RNA, 83 nt, Homo sapiens; identical to SEQ ID NO: 341

SEQ ID NO: 343 - RNA, 90 nt, Homo sapiens
ucucaggcugugaccuucucgaggaaagaagcacuuucuguugucugaaagaaaagaaagugcuuccuuucagaggguuacgguuugaga

SEQ ID NO: 344 - RNA, 90 nt, Homo sapiens
ucucagguugugaccuucucgaggaaagaagcacuuucuguugucugaaagaaaagaaagugcuuccuuucagaggguuacgguuugaga

SEQ ID NO: 345 - RNA, 90 nt, Homo sapiens
ucucaggcugugaccaucuggagguaagaagcacuuucuguuuugugaaagaaaagaaagugcuuccuuucagaggguuacucuuugaga

SEQ ID NO: 346 - RNA, 85 nt, Homo sapiens
ucucaugaugugaccaucuggagguaagaagcacuuuguguuuugugaaagaaagugcuuccuuucagaggguuacucuuugaga

SEQ ID NO: 347 - RNA, 87 nt, Homo sapiens
ucucaggcagugacccucuagauggaagcacugucuguuguauaaaagaaaagaucgugcaucccuuuagaguguuacuguuugaga

SEQ ID NO: 348 - RNA, 67 nt, Homo sapiens
gugacccucuagauggaagcacugucuguugucuaagaaaagaucgugcaucccuuuagaguguuac

SEQ ID NO: 349 - RNA, 95 nt, Homo sapiens
gaagaucucaggcagugacccucuagauggaagcacugucuguugucuaagaaaagaucgugcauccuuuuagaguguuacuguuugagaaaauc

SEQ ID NO: 350 - RNA, 85 nt, Homo sapiens
ucucaagcugugacugcaaagggaagcccuuucuguugucugaaagaagagaaagcgcuucccuuugcuggauuacgguuugaga

SEQ ID NO: 351 - RNA, 87 nt, Homo sapiens
ucucaagcugugggucugcaaagggaagcccuuucuguugucuaaaagaagagaaagcgcuucccuuugcuggauuacgguuugaga

SEQ ID NO: 352 - RNA, 83 nt, Homo sapiens
ucaugcuguggcccuccagagggaagcgcuuucuguugucugaaagaaaacaaagcgcuccccuuuagagguuuacgguuuga

SEQ ID NO: 353 - RNA, 101 nt, Homo sapiens
gcgagaagaucucaugcugugacucucuggagggaagcacuuucuguugucugaaagaaaacaaagcgcuucucuuuagaguguuacgguuugagaaaagc

SEQ ID NO: 354 - RNA, 87 nt, Homo sapiens
ucccaugcugugacccucuagagggaagcacuuucuguugucugaaagaaaccaaagcgcuucccuuuggagcguuacgguuugaga

SEQ ID NO: 355 - RNA, 88 nt, Homo sapiens
ucucaggcugugacccucuagagggaagcgcuuucuguuggcuaaaagaaaagaaagcgcuucccuucagaguguuaacgcuuugaga

SEQ ID NO: 356 - RNA, 87 nt, Homo sapiens
ucucaugcugugacccucuagagggaagcacuuucucuugucuaaaagaaaagaaagcgcuucucuuuagaggauuacucuuugaga

SEQ ID NO: 357 - RNA, 85 nt, Homo sapiens
cucaggcugugacacucuagagggaagcgcuuucuguugucugaaagaaaggaaagugcauccuuuuagaguguuacuguuugag

SEQ ID NO: 358 - RNA, 87 nt, Homo sapiens
ucucaggcugugucccucuacagggaagcgcuuucuguugucugaaagaaaggaaagugcauccuuuuagaguguuacuguuugaga

SEQ ID NO: 359 - RNA, 81 nt, Homo sapiens
caugcugugacccucuagagggaagcgcuuucuguugucugaaagaaaagaaagugcauccuuuuagagguuuacuguuug

SEQ ID NO: 360 - RNA, 87 nt, Homo sapiens
ucucagccugugacccucuagagggaagcgcuuucuguugucugaaagaaaagaaagugcaucuuuuuagaggauuacaguuugaga

SEQ ID NO: 361 - RNA, 88 nt, Homo sapiens
ucccaugcugugacccuccaaagggaagcgcuuucuguuuguuuucucuuaaacaaagugccucccuuuagaguguuaccguuuggga

SEQ ID NO: 362 - RNA, 84 nt, Homo sapiens
ucucaugcagucauucuccaaaagggagcacuuucuguuugaaagaaaacaaagugccuccuuuuagaguguuacuguuugaga

SEQ ID NO: 363 - RNA, 85 nt, Homo sapiens
cucaggcugugacccuccagagggaaguacuuucuguugucugagagaaaagaaagugcuucccuuuggacuguuucgguuugag

SEQ ID NO: 364 - RNA, 61 nt, Homo sapiens
cccucuacagggaagcgcuuucuguugucugaaagaaaagaaagugcuuccuuuuagaggg

SEQ ID NO: 365 - RNA, 87 nt, Homo sapiens
ucucaggcugucguccucuagagggaagcacuuucuguugucugaaagaaaagaaagugcuuccuuuuagaggguuaccguuugaga

SEQ ID NO: 366 - RNA, 87 nt, Homo sapiens
ucucaagcugugagucuacaaagggaagcccuuucuguugucuaaaagaaaagaaagugcuucucuuugguggguuacgguuugaga

SEQ ID NO: 367 - RNA, 87 nt, Homo sapiens
ucuccugcugugacccucaagauggaagcaguuucuguugucugaaaggaaagaaagugcuuccuuuuugaggguuacuguuugaga

SEQ ID NO: 368 - RNA, 87 nt, Homo sapiens
ucucaggcugugacccucuaaagggaagcgcuuucuguggucagaaagaaaagcaagugcuuccuuuuagaggguuaccguuuggga

SEQ ID NO: 369 - RNA, 90 nt, Homo sapiens
ucccaugcugugacccucuagaggaagcacuuucuguuuguugucugagaaaaaacaaagugcuucccuuuagaguguuaccguuuggga

SEQ ID NO: 370 - RNA, 88 nt, Homo sapiens
ucccaugcugugacccucuagaggaagcacuuucuguuuguugucugagaaaaaacaaagugcuucccuuuagaguuacuguuuggga

SEQ ID NO: 371 - RNA, 87 nt, Homo sapiens
ucucaggcugugacccuccaaagggaagaacuuucuguugucuaaaagaaaagaacgcacuucccuuuagaguguuaccgugugaga

SEQ ID NO: 372 - RNA, 87 nt, Homo sapiens
ucucgggcugugacucuccaaagggaagaauuuucucuugucuaaaagaaaagaacgcacuucccuuuagaguguuaccgugugaga

SEQ ID NO: 373 - RNA, 87 nt, Homo sapiens
ucucaggcugugucccucuagagggaagcgcuuucuguugucugaaagaaaagaaaaugguucccuuuagaguguuacgcuuugaga

SEQ ID NO: 374 - RNA, 87 nt, Homo sapiens
ucucaugcugugacccucuagagggaagcgcuuucuguugucugaaagaaaagaacgcgcuucccuauagaggguuacccuuugaga

SEQ ID NO: 375 - RNA, 87 nt, Homo sapiens
ucucaugcugugacccuacaaagggaagcacuuucucuuguccaaaggaaaagaaggcgcuucccuuuggaguguuacgguuugaga

SEQ ID NO: 376 - RNA, 85 nt, Homo sapiens
cucaagcugugacucuccagagggaugcacuuucucuuaugugaaaaaaaagaaggcgcuucccuuuagagcguuacgguuuggg

SEQ ID NO: 377 - RNA, 85 nt, Homo sapiens
cucaggcugugacccucuagagggaagcacuuucuguugcuugaaagaagagaaagcgcuuccuuuuagaggauuacucuuugag

SEQ ID NO: 378 - RNA, 65 nt, Homo sapiens
gugacccucuagagggaagcacuuucuguugaaagaaaagaacaugcauccuuucagaggguuac

SEQ ID NO: 379 - RNA, 83 nt, Homo sapiens
ucaggcugugacccucuugagggaagcacuuucuguugucugaaagaagagaaagugcuuccuuuuagaggcuuacugucuga

SEQ ID NO: 380 - RNA, 85 nt, Homo sapiens
ucucaagcugugacugcaaagggaagcccuuucuguugucuaaaagaaaagaaagugcuucccuuuggugaauuacgguuugaga

SEQ ID NO: 381 - RNA, 91 nt, Homo sapiens
cgacuugcuuucucuccuccaugccuugaguguaggaccguuggcaucuuaauuacccucccacacccaaggcuugcaaaaaagcgagccu

SEQ ID NO: 382 - RNA, 78 nt, Homo sapiens
auacuugaggagaaauuauccuugguguguucgcuuuauuuaugaugaaucauacaaggacaauuucuuuuugaguau

SEQ ID NO: 383 - RNA, 84 nt, Homo sapiens
acgucagggaaaggauucugcugucggucccacuccaaaguucacagaauggguggugggcacagaaucuggacucugcuugug

SEQ ID NO: 384 - RNA, 97 nt, Homo sapiens
cagaucucagacaucucggggaucaucaugucacgagauaccagugugcacuugugacagauugauaacugaaaggucugggagccacucaucuuca

SEQ ID NO: 385 - RNA, 78 nt, Homo sapiens
uacuuaaugagaaguugcccguguuuuuuucgcuuuauuugugacgaaacauucgcggugcacuucuuuuucaguauc

SEQ ID NO: 386 - RNA, 91 nt, Homo sapiens
auuuucaucaccuagggaucuuguuaaaaagcagauucugauucagggaccaagauucugcauuuuuagcaaguucucaagugaugcuaau

SEQ ID NO: 387 - RNA, 78 nt, Homo sapiens
ggaauuuuguuaaaaugcagaauccauuucuguagcucugagacuagaccugagguugugcauuucuaacaaagugcc

SEQ ID NO: 388 - RNA, 106 nt, Homo sapiens
cccagccuggcacauuaguaggccucaguaaauguuuauuagaugaauaaaugaaugacucaucagcaaacauuuauugugugccugcuaaagugagcuccacagg

SEQ ID NO: 389 - RNA, 97 nt, Homo sapiens
ugcagggagguauuaaguuggugcaaaaguaauugugauuuuugccauuaaaaguaacgacaaaacuggcaauuacuuuugcaccaaaccugguauu

SEQ ID NO: 390 - RNA, 97 nt, Homo sapiens
ugugauguguauuagguuugugcaaaaguaauugggguuuuuugccguuaaaaguaauggcaaaacuggcaauuacuuuugcaccaaacuaauauaa

SEQ ID NO: 391 - RNA, 97 nt, Homo sapiens
ccuagaauguuauuaggucggugcaaaaguaauugcgaguuuuaccauuacuuucaauggcaaaacuggcaauuacuuuugcaccaacguaauacuu

SEQ ID NO: 392 - RNA, 97 nt, Homo sapiens
cuuuauuagucuggugcaaaagaaacugugguuuuugccauuacuuuuacaggcaaaaaccacaauuacuuuugcaccaaccuaauauaacuuguuu

SEQ ID NO: 393 - RNA, 97 nt, Homo sapiens
uuuuauuagguuggugcaaaagaaacugugguuuuugccauuacuuucaauggcaaaaaccacaauuacuuuugcaccaaccuaaaucuucccucuc

SEQ ID NO: 394 - RNA, 84 nt, Homo sapiens
auguuggugcaaaaguaauuguggauuuugcuauuacuuguauuuauuuguaaugcaaaacccgcaauuaguuuugcaccaacc

SEQ ID NO: 395 - RNA, 88 nt, Homo sapiens
guauuagguuggugcaaaaguuauugugguuuuugcuauuuuuuuuuaauggcaaaaaccggcaauuacuuuugcacuaaccuaguag

SEQ ID NO: 396 - RNA, 82 nt, Homo sapiens
cuguuagguuggugcaaaaguaauugugguuuuugaaaguaacuuggcgaaaacgacaaugacuuuugcaccaaucuaauac

SEQ ID NO: 397 - RNA, 70 nt, Homo sapiens
gcaguuuuugccauuaaguugcgguuuuugccauuauaauggcaaaaacugcaauuacuuucacaccugc

SEQ ID NO: 398 - RNA, 67 nt, Homo sapiens
ugugcaaaaguaauugugguuuuugucauuuaaaaguaauggcaaaaacugcaauuacuuucacacc

SEQ ID NO: 399 - RNA, 66 nt, Homo sapiens
gugcaaagguaauugugguuucugcuuuuaaagguaauggcaaauauuacauuuacuuuugcacca

SEQ ID NO: 400 - RNA, 64 nt, Homo sapiens
ugcaaagguaauugugguuucugccauugaaaguaaaggcaagaaccucaauuaccuuugcagc

SEQ ID NO: 401 - RNA, 76 nt, Homo sapiens
agguuggugcaaaagugauugcaguguuugccaauaaaaguaaugacaaaaacugcaguuacuuuugcaccagccc

SEQ ID NO: 402 - RNA, 88 nt, Homo sapiens
guauuagguuggugcaaagguaauugcaguuuuucccauuuaaaauauggaaaaaaaaaucacaauuacuuuugcaucaaccuaauaa

SEQ ID NO: 403 - RNA, 72 nt, Homo sapiens
auugguguaaaaguaauugcagguuaugccauuaaaaguaaugguaaaaacugcaauuacuuuuacacuaac

SEQ ID NO: 404 - RNA, 92 nt, Homo sapiens
aagguauuagguuggugcaaaaguaauugcaguuuuugcuauuacuuuuaaugguaaaaacugcaauuacuuuuacaccaaccuaauauuua

SEQ ID NO: 405 - RNA, 57 nt, Homo sapiens
gugcaaaaguaacugcgguuuuugagaaguaauugaaaaccgcaauuacuuuugcag

SEQ ID NO: 406 - RNA, 97 nt, Homo sapiens
ggucggugcaaaaguaauugcuguuuuugccauuaaaaauaauggcauuaaaaguaauggcaaaaacggcaaugacuuuuguaccaaucuaauaucu

SEQ ID NO: 407 - RNA, 74 nt, Homo sapiens
aguuggugcaaaaguaauugcgguuuuugccgucgaaaauaauggcaaaaacugcaguuacuuuuguaccaaug

SEQ ID NO: 408 - RNA, 83 nt, Homo sapiens
cauuagguuggugcaaaaggcauugugguuuuugccuauaaaaguaauggcaaaaaccgcaauuccuuuugcaccaaccuaau

SEQ ID NO: 409 - RNA, 96 nt, Homo sapiens
aacuauucuuagguugaugcagaaguaacuacgguuuuugcaguugaaaguaauggcaaagaccgugacuacuuuugcaacagccuaauaguuucu

SEQ ID NO: 410 - RNA, 96 nt, Homo sapiens
accaauuccuagguuggugcaaaaguaauugcggucuuugucauuaaaaccaauaacaaaaaccacaauuacuuuuuacugaccuaaagauuaauu

SEQ ID NO: 411 - RNA, 58 nt, Homo sapiens
gaaaguaauugcuguuuuugccauuacuuucaguggcaaaaacugcaauuacuuuugc

SEQ ID NO: 412 - RNA, 57 nt, Homo sapiens
aaaaguaauugcaguuuuugcuguugaacguagugguaaaacugcaguuauuuuugc

SEQ ID NO: 413 - RNA, 58 nt, Homo sapiens
aaaaguaauugcggguuuugccguugcuuuuaaugguaaaacccacaauuauguuugu

SEQ ID NO: 414 - RNA, 58 nt, Homo sapiens
aaaaguuauugcgguuuuggcugccaaaagaaauggccaaaaccgcaguaacuuuugu

SEQ ID NO: 415 - RNA, 54 nt, Homo sapiens
aaaaguaauugcgguuuuugcuauugguuuuaauggcaguuacuuuugcaccag

SEQ ID NO: 416 - RNA, 62 nt, Homo sapiens
aaaaguacuugcggauuugccaucaccuuuaccuuuaauggcaaaacugcaguuacuuuugc

SEQ ID NO: 417 - RNA, 65 nt, Homo sapiens
uaggucggugcaaaagucaucacgguuuuuaccauuaaaaccgcgaugacuuuugcaucaaccua

SEQ ID NO: 418 - RNA, 73 nt, Homo sapiens
gauuggugcagaaguaauugcgguuuugccauggaaaguaauggcaaaaaccguaauuacuuuuguaccaacc

SEQ ID NO: 419 - RNA, 107 nt, Homo sapiens
agaagaugcuuacuacuagguuggugcaaaaguaauugugguuuuugcauuuaaaguaauggccaaaaccgcgauuacucuugcacgaaccuaacgguaacacuucu

SEQ ID NO: 420 - RNA, 95 nt, Homo sapiens
agauuguauuagguuggugcaaaagugauugugguuuuugcuguuacuuuuaauggcaaaaacugcaaucacuuuugcaccaaccuaauaaauuu

SEQ ID NO: 421 - RNA, 97 nt, Homo sapiens
cagacuauauauuuagguuggcgcaaaaguaauugugguuuuggccuuuauuuucaauggcaagaaccucaguugcuuuugugccaaccuaauacuu

SEQ ID NO: 422 - RNA, 56 nt, Homo sapiens
aaagguaacugugauuuuugcuauuagaaaguaauggcaaaaacugcaauuacuuu

SEQ ID NO: 423 - RNA, 97 nt, Homo sapiens
cauuggcaucuauuagguuggugcaaaaguaauugcgguuuuugccauuacuuucaguagcaaaaaucucaauuacuuuugcaccaacuuaauacuu

SEQ ID NO: 424 - RNA, 97 nt, Homo sapiens
aaacaaguuauauuagguuggugcaaaaguaauugugguuuuugccuguaaaaguaauggcaaaaaccacaguuucuuuugcaccagacuaauaaag

SEQ ID NO: 425 - RNA, 97 nt, Homo sapiens
gagagggaagauuuagguuggugcaaaaguaauugugguuuuugccauugaaaguaauggcaaaaaccacaguuucuuuugcaccaaccuaauaaaa

SEQ ID NO: 426 - RNA, 88 nt, Homo sapiens
uuauuagguugguacaaaagcaaucgcgguuuuugcuauuacuuuuaaaggcaaaaacugagacuacuuuugcaccaaccugauagaa

SEQ ID NO: 427 - RNA, 84 nt, Homo sapiens
auuagguuggugcaaaaguaaucacaguuuuugacauuacuuucaaagacaaaaacuguaauuacuuuuggaccaaccuaauag

SEQ ID NO: 428 - RNA, 98 nt, Homo sapiens
uaauaacuauuagguuggugcgaacauaauugcaguuuuuaucauuacuuuuaauggcaaaaacuguaauuacuuuugcaccaaccuaauauuuuagu

SEQ ID NO: 429 - RNA, 87 nt, Homo sapiens
auuagguuggugcaaaccuaauugcaauuuuugcaguuuuuuuaaguaauugcaaaaacuguaauuacuuuugcaccaaccuaauac

SEQ ID NO: 430 - RNA, 105 nt, Homo sapiens
gaguucuaacguauuagguuggugcaaaaguaauagugguuuuugccauuaaaaguaaugacaaaaacuguaauuacuuuuggaacaauauuaauagaauuucag

SEQ ID NO: 431 - RNA, 86 nt, Homo sapiens
uauuagguugcugcaaaaguaaucauguuuuuuuccauuguaaguaaugggaaaaacuguaauuacuuuuguaccaaccuaauagc

SEQ ID NO: 432 - RNA, 89 nt, Homo sapiens
aguuauuagauuagugcaaaaguaauugcaguuuuugcauuacguucuauggcaaaacuguaauuacuuuuguaccaacauaauacuuc

SEQ ID NO: 433 - RNA, 102 nt, Homo sapiens
ucuguccauuaggugggugcaaaaguaaucgcgguuuuugucauuacuuuuaaugguaaaaacuggaauuacuuuugcacugaccuaauauuaagccagaua

SEQ ID NO: 434 - RNA, 88 nt, Homo sapiens
guauuagguuggugcaaaaguaaucgcgguuuuugucauuacuuucaauggcaaacaccacaauuacuuuugcaccaaccuaauauaa

SEQ ID NO: 435 - RNA, 118 nt, Homo sapiens
ucugauucugcauguauuagguuggugcaaaaguaaucgcgguuuuugucauugaaaguaauagcaaaaacugcaauuacuuuugcaccaaccuaaaaguagucacugucuucagaua

SEQ ID NO: 436 - RNA, 111 nt, Homo sapiens
gcuauuagguuggugcaaaaguaaucgcgguuuuugucauuacuuuaauuacuuuacguuucauuaaugacaaaaaccgcaauuacuuuugcaccaaccuaauacuugcua

SEQ ID NO: 437 - RNA, 60 nt, Homo sapiens
acaaaaguaaucgcgguuuuugucauuacuuuuaacuguaaaaaccacgguugcuuuugc

SEQ ID NO: 438 - RNA, 149 nt, Homo sapiens
cagauggcucugaaguuugcacccuauuagguuggugcaaaaguaauugcggauuuugccauuaaaaguaauggcaaaaauagcaauuauuuuuguaccagccuaguaucuuuucuccuucuaccaaacuuugucccugagccaucuca

SEQ ID NO: 439 - RNA, 149 nt, Homo sapiens
uagauggcuccgaaguuugcauccuauuaguuuggugcaaaaguaauugcggauuuugccauuaaaaguaauggcaaaaauagcaauuauuuuuguaccagccuaguaucuuuucuccuucuaacaaaguucgucccugauccaucuca

SEQ ID NO: 440 - RNA, 149 nt, Homo sapiens
cagauggcuccgaaguuuacauccuauuagguuugugcaaaaguaauugcggauuuugccauuaaaaguaauggcaaaaauagcaauuauuuuuguaccagccuaguaucuuuucuccuucuaccaaacuuugucccugagccaucuca

SEQ ID NO: 441 - RNA, 77 nt, Homo sapiens
agguuggugcaaaaguaauugcggauuuugccauacuuuuaacggcaaaaaccacaaauauuauugcaccaaccuau

SEQ ID NO: 442 - RNA, 112 nt, Homo sapiens
gggcagccagugaauaguuagcuggugcaaaaguaauugcggucuuugguauuacuuucaguggcaaaaacugcauuacuuuugcaccagccuacuagaacgcugaguucag

SEQ ID NO: 443 - RNA, 116 nt, Homo sapiens
cuuuucucaaguauugcuguuagguuggugcaaaaguacuugcggauuuugcuuuacuuuuaauggcaaaaaccgcaauuauuuuugcuucaaccuaauaugaugcaaaauuggcu

SEQ ID NO: 444 - RNA, 86 nt, Homo sapiens
uauuagguuggugcaaaaguauuugcggguuuugucguagaaaguaauggcaaaaacugcaguuacuugugcaccaaccaaaugcu

SEQ ID NO: 445 - RNA, 86 nt, Homo sapiens
auauuagguuggugcaaagguauuugugguuuuugucauuaaaguaaugcaaaagccacaaauaccuuugcaccaaccuaauauua

SEQ ID NO: 446 - RNA, 75 nt, Homo sapiens
agguuggugcaaaaguaauuguggauuuugucguuaaaaauagcaaaacccgcaauuacuuuugcaccaaccuaa

SEQ ID NO: 447 - RNA, 114 nt, Homo sapiens
uggugaaaauguguugauuguaaugguuccuauucugaucaauaaacaugguuugagccuaguuacaaugaucuaaaauucacgguccaaaacugcaguuacuuuugcaccaac

SEQ ID NO: 448 - RNA, 70 nt, Homo sapiens
uggugcaaaaguaauugcgguuuuugccauuaaaaguaaugcggccaaaacugcaguuacuuuugcaccc

SEQ ID NO: 449 - RNA, 84 nt, Homo sapiens
auuagguugguauaaaauuaauugcaguuuuugucauuacuuucaauagcaaaaacugcaguuacuuuugcaccaauguaauac

SEQ ID NO: 450 - RNA, 100 nt, Homo sapiens
auauuaggcuggugcaaaaguaauggcgguuuuugccauuacuuuucauuuuuaccauuaaaaguaauggcaaaaagcaugauuacuuuuucaccaaccu

SEQ ID NO: 451 - RNA, 82 nt, Homo sapiens
uugcugcaaaaauaauugcaguuuuugccauuauuuuuaauaauuauaauaauggccaaaacugcaguuauuuuugcaccaa

SEQ ID NO: 452 - RNA, 74 nt, Homo sapiens
aggguggugcaaaagugaucgugguuuuugcaauuuuuuaaugacaaaaaccacaauuacuuuugcaccaaccu

SEQ ID NO: 453 - RNA, 81 nt, Homo sapiens
auuaggauggugcaaaaguaaugugguuuuuuucuuuacuuuuaauggcaaagacugcaauuacuuuugcgccaaccuaau

SEQ ID NO: 454 - RNA, 80 nt, Homo sapiens
aauacuagguuugagcaaaaguaauugcgguuuugccaucaugccaaaagcuacaguuacuuuugcaccagccuaauauu

SEQ ID NO: 455 - RNA, 74 nt, Homo sapiens
gguuggugcaaaaguaacugcgguuuuugccuuucaacauaauggcaaaacccacaauuacuuuugcaccaauc

SEQ ID NO: 456 - RNA, 75 nt, Homo sapiens
agguuagugcaaaaguaauugcaguuuuugcguuacuuucaaucguaaaaacugcaauuacuuucacaccaaucu

SEQ ID NO: 457 - RNA, 100 nt, Homo sapiens
augccaaauauuagguuggcacaaaaguaauuguggcuuuugccauuaaaaguaaugguaaaaacugcaauuacuuucgugccaaccuaauauuugugug

SEQ ID NO: 458 - RNA, 110 nt, Homo sapiens
gccuaaacuauuagguuggugcaaaaguaaucacuguuuuugccauuacucucaguggcaaaaaccgugauuacuuuugcaccaaccuaguaacaccuucacuguggggg

SEQ ID NO: 459 - RNA, 97 nt, Homo sapiens
aaguauuaaguuggugcaaaaguaauugagauuuuugcuacugaaaguaauggcaaaaaccgcaauuacuuuugcaccaaccuaauagaugccaaug

SEQ ID NO: 460 - RNA, 96 nt, Homo sapiens
agacaugcaacucaagaauauauugagagcucauccauaguugucacugucucaaaucagugacaacuauggaugagcucuuaauauaucccaggc

SEQ ID NO: 461 - RNA, 97 nt, Homo sapiens
ugaugcuuugcuggcuggugcagugccugagggaguaagagcccuguuguuguaagauagugucuuacucccucaggcacaucuccaacaagucucu

SEQ ID NO: 462 - RNA, 97 nt, Homo sapiens
ugaugcuuugcuggcuggugcagugccugagggaguaagagcccuguuguugucagauagugucuuacucccucaggcacaucuccagcgagucucu

SEQ ID NO: 463 - RNA, 95 nt, Homo sapiens
gaugcuuugcuggcuggugcagugccugagggaguaagaguccuguuguuguaagauagugucuuacucccucaggcacaucuccaacaagucuc

SEQ ID NO: 464 - RNA, 97 nt, Homo sapiens
agagacuuguuggagaugugccugagggaguaagacacuaucuuacaacaacagggcucuuacucccucaggcacugcaccagccagcaaagcauca

SEQ ID NO: 465 - RNA, 97 nt, Homo sapiens
agagacucgcuggagaugugccugagggaguaagacacuaucugacaacaacagggcucuuacucccucaggcacugcaccagccagcaaagcauca

SEQ ID NO: 466 - RNA, 96 nt, Homo sapiens
ggggacugccgggugacccuggaaauccagaguggguggggccagucugaccguuucuaggcgacccacucuugguuuccaggguugcccuggaaa

SEQ ID NO: 467 - RNA, 96 nt, Homo sapiens
agaugugcucuccuggcccaugaaaucaagcgugggugagaccuggugcagaacgggaaggcgacccauacuugguuucagaggcugugagaauaa

SEQ ID NO: 468 - RNA, 96 nt, Homo sapiens
aaccauucaaauauaccacaguuuguuuaaccuuuugccuguugguugaagaugccuuucaacaggugacugguuagacaaacugugguauauaca

SEQ ID NO: 469 - RNA, 68 nt, Homo sapiens
cuucaauuuuauuuuaaaacggugagauuuuguuuugucugagaaaaucucgcuguuuuagacugagg

SEQ ID NO: 470 - RNA, 96 nt, Homo sapiens
accugaguaaccuuugcuaguccugacucagccaguacuggucuuagacuggugaugggucaggguucauauuuuggcaucucucucugggcaucu

SEQ ID NO: 471 - RNA, 96 nt, Homo sapiens
ggagugaacucagauguggagcacuaccuuugugagcagugugacccaaggccuguggacaggguaagcugaaccucugauaaaacucugaucuau

SEQ ID NO: 472 - RNA, 95 nt, Homo sapiens
gauaguaauaagaaagaugagcucauuguaauaugagcuucauuuauacauuucauauuaccauuagcucaucuuuuuuauuacuaccuucaaca

SEQ ID NO: 473 - RNA, 98 nt, Homo sapiens
agaaugggcaaaugaacaguaaauuuggaggccuggggcccucccugcugcuggagaaguguuugcacgggugggccuugucuuugaaaggaggugga

SEQ ID NO: 474 - RNA, 94 nt, Homo sapiens
gugugugugugugugugugguuauuuugguauaguagcucuagacucuauuauaguuuccugagcugcuguaccaaaauaccacaaacgggcug

SEQ ID NO: 475 - RNA, 96 nt, Homo sapiens
gcuccaguaacaucuuaaaguaaauaugcaccaaaauuacuuuugguaaauacaguuuuggugcauauuuacuuuaggauguuacuggagcuccca

SEQ ID NO: 476 - RNA, 97 nt, Homo sapiens
cuucauccaccaguccuccaggaacaucaaggaucuuaaacuuugccagagcuacaaaggcaaaguuuaagauccuugaaguuccugggggaaccau

SEQ ID NO: 477 - RNA, 95 nt, Homo sapiens
agugaaauugcuaggucauauggucagucuacuuuuagaguaauugugaaacuguuuuucaaaguagcuguaccauuugcacucccuguggcaau

SEQ ID NO: 478 - RNA, 79 nt, Homo sapiens
agcaaagaaguguguugcccucuaggaaauguguguugcucugauguaauuagguugacauacguuucccugguagcca

SEQ ID NO: 479 - RNA, 94 nt, Homo sapiens
cgggcagcgggugccaggcacggugucagcaggcaacauggccgagaggccggggccuccgggcggcgccguguccgcgaccgcguacccugac

SEQ ID NO: 480 - RNA, 94 nt, Homo sapiens
gcuaggcgugguggcgggcgccugugaucccaacuacucaggaggcuggggcagcagaaucgcuugaacccgggaggcgaagguugcagugagc

SEQ ID NO: 481 - RNA, 98 nt, Homo sapiens
ggauucuuauaggacaguauguucuuccaggacagaacauucuuugcuauuuuguacuggaagaacaugcaaaacuaaaaaaaaaaaaaguuauugcu

SEQ ID NO: 482 - RNA, 95 nt, Homo sapiens
gauauacacuauauuauguauaaauguauacacacuuccuauauguauccacauauauauaguguauauauuauacauguauagguguguauaug

SEQ ID NO: 483 - RNA, 96 nt, Homo sapiens
gguauuguuagauuaauuuugugggacauuaacaacagcaucagaagcaacaucagcuuuaguuaaugaauccuggaaaguuaagugacuuuauuu

SEQ ID NO: 484 - RNA, 97 nt, Homo sapiens
cuagauaaguuauuaggugggugcaaagguaauugcaguuuuucccauuauuuuaauugcgaaaacagcaauuaccuuugcaccaaccugauggagu

SEQ ID NO: 485 - RNA, 96 nt, Homo sapiens
ccucaguaagaccaagcucagugugccauuuccuugucuguagccaugucuaugggcucuugaguuggccaucugagugagggccugcuuauucua

SEQ ID NO: 486 - RNA, 95 nt, Homo sapiens
gucgaggccguggcccggaaguggucggggccgcugcgggcggaagggcgccugugcuucguccgcucggcgguggcccagccaggcccgcggga

SEQ ID NO: 487 - RNA, 99 nt, Homo sapiens
uuuagcgguuucucccugaagugauguguaacugaucaggaucuacucaugucgucuuugguaaaguuaugucgcuugucagggugaggagaguuuuug

SEQ ID NO: 488 - RNA, 96 nt, Homo sapiens
gggaccugcgugggugcgggcgugugagugugugugugugagugugugucgcuccggguccacgcucaugcacacacccacacgcccacacucagg

SEQ ID NO: 489 - RNA, 94 nt, Homo sapiens
aauucagcccugccacuggcuuaugucaugaccuugggcuacucaggcugucugcacaaugagccaguuggacaggagcagugccacucaacuc

SEQ ID NO: 490 - RNA, 98 nt, Homo sapiens
uacaauccaacgaggauucuaauuucuccacgucuuugguaauaagguuuggcaaagauguggaaaaauuggaauccucauucgauugguuauaacca

SEQ ID NO: 491 - RNA, 96 nt, Homo sapiens
ugggggagugaagaguagauaaaauauugguaccugaugaaucugaggccagguuucaauacuuuaucugcucuucauuuccccauaucuacuuac

SEQ ID NO: 492 - RNA, 96 nt, Homo sapiens
agauaaaucuauagacaaaauacaaucccggacaacaagaagcuccuauagcuccuguagcuucuugugcucuaggauuguauuuuguuuauauau

SEQ ID NO: 493 - RNA, 98 nt, Homo sapiens
cauauuagguuaaugcaaaaguaaucgcgguuugugccagaugacgauuugaauuaauaaauucauuugguauaaaccgcgauuauuuuugcaucaac

SEQ ID NO: 494 - RNA, 97 nt, Homo sapiens
auaaaauuuccaauuggaaccuaaugauucaucagacucagauauuuaaguuaacaguauuugagaaugaugaaucauuagguuccggucagaaauu

SEQ ID NO: 495 - RNA, 96 nt, Homo sapiens
guuaugugaagguauucuuguguucucuagaucagugcuuuuagaaaauuugugugaucuaaagaacacaaagaauaccuacacagaaccaccugc

SEQ ID NO: 496 - RNA, 98 nt, Homo sapiens
aucugugcucuuugauuacaguuguucaaccaguuacuaaucuaacuaauuguaacugguugaacaacugaacccaaagggugcaaaguagaaacauu

SEQ ID NO: 497 - RNA, 75 nt, Homo sapiens
aacucacacauuaaccaaagaggaaggucccauuacugcagggaucuuagcaguacugggaccuaccucuuuggu

SEQ ID NO: 498 - RNA, 97 nt, Homo sapiens
uagggugaccagccauuaugguuugccugggacugaggaauuugcugggauaugucaguuccaggccaaccaggcugguuggucucccugaagcaac

SEQ ID NO: 499 - RNA, 94 nt, Homo sapiens
uggggugucugugcuauggcagcccuagcacacagauacgcccagagaaagccugaacguugggcguaucuguaugcuagggcugcuguaacaa

SEQ ID NO: 500 - RNA, 97 nt, Homo sapiens
augggguaaaaccauuaugcauuguauuuuuaggucccaauacaugugggcccuaaaaauacaaugcauaaugguuuuucacucuuuaucuucuuau

SEQ ID NO: 501 - RNA, 96 nt, Homo sapiens
cuccuaugcacccucuuuccauaggugaugagucacagggcucagggaaugugucugcaccugugacucaucaccaguggaaagcccaucccauau

SEQ ID NO: 502 - RNA, 83 nt, Homo sapiens
agcuuagguaccaauuuggccacaauggguuagaacacuauuccauuguguucuuacccaccauggccaaaauugggccuaag

SEQ ID NO: 503 - RNA, 99 nt, Homo sapiens
uccagccugugcccagcagccccugagaaccacgucugcucugagcuggguacugccuguucagaacaaaugccgguucccagacgcugccagcuggcc

SEQ ID NO: 504 - RNA, 97 nt, Homo sapiens
uagccagucagaaaugagcuuauucauaaaagugcaguauggugaagucaaucuguaauuuuauguauaagcuagucucugauugaaacaugcagca

SEQ ID NO: 505 - RNA, 95 nt, Homo sapiens
ucuuaucaaugagguagaccauggguucucauuguaauaguguagaauguugguuaacuguggacucccuggcucugucucaaaucuacugauuc

SEQ ID NO: 506 - RNA, 97 nt, Homo sapiens
uauuaugccaugacauugugucaauaugcgaugauguguugugauggcacagcgucaucacguggugacgcaacaucaugacguaagacgucacaac

SEQ ID NO: 507 - RNA, 100 nt, Homo sapiens
cccccagaaucugucaggcaccagccaggcauugcucagcccguuucccucugggggagcaaggaguggugcuggguuugucucugcugggguuucuccu

SEQ ID NO: 508 - RNA, 96 nt, Homo sapiens
acggaagccugcacgcauuuaacaccagcacgcucaauguagucuuguaaggaacagguugaagugugccguggugugucuggaggaagcgccugu

SEQ ID NO: 509 - RNA, 77 nt, Homo sapiens
agcacggccucuccgaagccugcccggcuccucgggaaccugccucccgcauggcagcugcugcccuucggaggccg

SEQ ID NO: 510 - RNA, 97 nt, Homo sapiens
uacuuacucuacgugugugucacucgaugaccacugugaagacaguaaaauguacagugguucucuuguggcucaagcguaauguagaguacugguc

SEQ ID NO: 511 - RNA, 97 nt, Homo sapiens
gcuugaugaugcugcugaugcuggcggugaucccgauggugugagcuggaaauggggugcuacgucaucguugucaucgucaucaucaucauccgag

SEQ ID NO: 512 - RNA, 95 nt, Homo sapiens
aaagacaugcuguccacaguguguuugauaagcugacaugggacagggauucuuuucacuguugugucaguuuaucaaacccauacuuggaugac

SEQ ID NO: 513 - RNA, 98 nt, Homo sapiens
aagucacgugcuguggcuccagcuucauaggaaggcucuugucugucaggcaguggaguuacuuacagacaagagccuugcucaggccagcccugccc

SEQ ID NO: 514 - RNA, 79 nt, Homo sapiens
ugcaugaguucgucuuggucuaggauuguuggaggagucagaaaaacuaccccagggauccugaaguccuuugggugga

SEQ ID NO: 515 - RNA, 98 nt, Homo sapiens
uucucacccccgccugacacgggcgacagcugcggcccgcuguguucacucgggccgagugcgucuccugucaggcaagggagagcagagccccccug

SEQ ID NO: 516 - RNA, 97 nt, Homo sapiens
gauugaugcuguugguuuggugcaaaaguaauugcagugcuucccauuuaaaaguaauggcacacacugcaauuacuuuugcuccaacuuaauacuu

SEQ ID NO: 517 - RNA, 94 nt, Homo sapiens
agagcaucgugcuugaccuuccacgcucucguguccacuagcaggcagguuuucugacacaggcugcggaauucaggacagugcaucauggaga

SEQ ID NO: 518 - RNA, 83 nt, Homo sapiens
gcccuagcuugguucuaaaucccauggugccuucuccuugggaaaaacagagaaggcacuaugagauuuagaaucaaguuagg

SEQ ID NO: 519 - RNA, 96 nt, Homo sapiens
uguauccuugguuuuuaguaguuuuacuaugaugaggugugccauccaccccaucauaguaaacuacugaaaaucaaagauacaagugccugacca

SEQ ID NO: 520 - RNA, 96 nt, Homo sapiens
uugccuaaagucacacagguuauagaucuggauuggaacccagggagccagacugccuggguucaaauccagaucuauaacuugugugacuuuggg

SEQ ID NO: 521 - RNA, 100 nt, Homo sapiens
gggccaaggugggccaggggugguguugggacagcuccguuuaaaaaggcaucuccaagagcuuccaucaaaggcugccucuuggugcagcacagguaga

SEQ ID NO: 522 - RNA, 95 nt, Homo sapiens
ugcucggcuguuccuaggguguuucucucaucucuggucuauaauggguuaaauaguagagaugagggcaacacccuaggaacagcagaggaacc

SEQ ID NO: 523 - RNA, 96 nt, Homo sapiens
ucuauuugucuuaggugagcuaaaugugugcugggacacauuugagccaaaugucccagcacacauuuagcucacauaagaaaaauggacucuagu

SEQ ID NO: 524 - RNA, 67 nt, Homo sapiens
aaaauggugagagcguugaggggaguuccagacggagaugcgaggaccccucggggucugacccaca

SEQ ID NO: 525 - RNA, 100 nt, Homo sapiens
ucccaucuggacccugcugggcagggcuucugagcuccuuagcacuagcaggaggggcuccaggggcccucccuccauggcagccaggacaggacucuca

SEQ ID NO: 526 - RNA, 95 nt, Homo sapiens
ggugagugcguuuccaagugugaagggacccuuccuguagugucuuauauacaauacaguaggaauguuccuucuuugccacucauacaccuuua

SEQ ID NO: 527 - RNA, 90 nt, Homo sapiens
ucuaagaaacgcaguggucucugaagccugcaggggcaggccagcccugcacugaacgccuguucuugccagguggcagaagguugcugc

SEQ ID NO: 528 - RNA, 96 nt, Homo sapiens
cucgggaggggcgggagggggguccccggugcucggaucucgagggugcuuauuguucgguccgagccugggucucccucuuccccccaacccccc

SEQ ID NO: 529 - RNA, 97 nt, Homo sapiens
uuagguaauuccuccacucaaaacccuucagugacuuccaugacaugaaauaggaagucauuggaggguuugagcagaggaaugaccuguuuuaaaa

SEQ ID NO: 530 - RNA, 97 nt, Homo sapiens
caucauaaggagccuagacuucccauuugaagguggccauuuccuaccaccuucaaaugguaaguccaggcuccuucugauucaauaaaugaggagc

SEQ ID NO: 531 - RNA, 98 nt, Homo sapiens
cucuuguucacagccaaacucuacuuguccuucugaguguaauuacguacaugcaguagcucaggagacaagcagguuuacccuguggaugagucuga

SEQ ID NO: 532 - RNA, 99 nt, Homo sapiens
cgcccaccucagccucccaaaaugcugggauuacaggcaugagccacugcggucgaccaugaccuggacauguuugugcccaguacugucaguuugcag

SEQ ID NO: 533 - RNA, 95 nt, Homo sapiens
auauauaucuauaucuagcuccguauauauauauauauauauauagauaucuccauauauauggagauagauauagaaauaaaacaagcaaagaa

SEQ ID NO: 534 - RNA, 96 nt, Homo sapiens
uagauugaggaaggggcugagugguaggcggugcugcugugcucugaugaagacccauguggcuagcaacagcgcuuaccuuuugucucugggucc

SEQ ID NO: 535 - RNA, 96 nt, Homo sapiens
agagaagcuggacaaguacuggucucagcagauugaggagagcaccacaguggucaucacacagucugcugagguuggagcugcugagaugacacu

SEQ ID NO: 536 - RNA, 98 nt, Homo sapiens
guacacaguagaagcaucccuugcaggggcuguuggguugcauccuaagcugugcuggagcuucccgauguacucuguagaugucuuugcaccuucug

SEQ ID NO: 537 - RNA, 97 nt, Homo sapiens
aaugcuguuucaagguaguaccaguaccuuguguucaguggaaccaagguaaacacaagguauugguauuaccuugagauagcauuacaccuaagug

SEQ ID NO: 538 - RNA, 85 nt, Homo sapiens
aggguagagggaugagggggaaaguucuauaguccuguaauuagaucucaggacuauagaacuuucccccucaucccucugcccu

SEQ ID NO: 539 - RNA, 94 nt, Homo sapiens
acugauauauuugucuuauuugagagcugaggaguauuuuuaugcaaucugaaugaucucagcugucugaaaaugucuucaauuuuaaaggcuu

SEQ ID NO: 540 - RNA, 97 nt, Homo sapiens
uacuuauuacugguagugagucucuaagaaaagaggaggugguuguuuuccuccucuuuucuuugagacucacuaccaauaauaagaaauacuacua

SEQ ID NO: 541 - RNA, 95 nt, Homo sapiens
auagcuguugugucacuuccucaugcugacauauuuacuagaggguaaaauuaauaaccuucuaguaagaguggcagucgaagggaagggcucau

SEQ ID NO: 542 - RNA, 97 nt, Homo sapiens
ucccuuucccaggggaggggcuggguuuacguugggagaacuuuuacggugaaccaggagguucucccaacguaagcccagccccuccccucugccu

SEQ ID NO: 543 - RNA, 97 nt, Homo sapiens
aacuuaacaucaugcuaccucuuuguaucauauuuuguuauucuggucacagaaugaccuaguauucuguaccagggaagguaguucuuaacuauau

SEQ ID NO: 544 - RNA, 75 nt, Homo sapiens
guggggagccugguuagaccuggcccagaccucagcuacacaagcugauggacugagucaggggccacacucucc

SEQ ID NO: 545 - RNA, 94 nt, Homo sapiens
cgccuccuaccgcagugcuugacgggaggcggagcggggaacgaggccgucggccauuuugugucugcuuccugugggacguggugguagccgu

SEQ ID NO: 546 - RNA, 98 nt, Homo sapiens
aaccucucuuagccucuguuucuuuauugcgguagauacuauuaaccuaaaaugagaaggcuaauaguaucuaccacaauaaaauuguugugaggaua

SEQ ID NO: 547 - RNA, 97 nt, Homo sapiens
aaacccacaccacugcauuuuggccaucgaggguuggggcuuggugucaugccccaagauaaccagcaccccaacuuuggacagcauggauuagucu

SEQ ID NO: 548 - RNA, 98 nt, Homo sapiens
cagagaggagcugccacuugggcacugaaacaauguccauuaggcuuuguuauggaaacuucuccugaucauuguuuuguguccauugagcuuccaau

SEQ ID NO: 549 - RNA, 99 nt, Homo sapiens
uggcggccugggcgggagcgcgcgggcggggccggccccgcugccuggaauuaaccccgcugugcuugcucgucccgcccgcagcccuaggcggcgucg

SEQ ID NO: 550 - RNA, 99 nt, Homo sapiens
uggcuaagguguuggcucgggcuccccacugcaguuacccuccccucggcguuacugagcacugggggcuuucgggcucugcgucugcacagauacuuc

SEQ ID NO: 551 - RNA, 100 nt, Homo sapiens
gugagcgggcgcggcagggaucgcgggcggguggcggccuagggcgcggagggcggaccgggaauggcgcgccgugcgccgccggcguaacugcggcgcu

SEQ ID NO: 552 - RNA, 98 nt, Homo sapiens
uggccgacggggcgcgcgcggccuggaggggcggggcggacgcagagccgcguuuagucuaucgcugcgguugcgagcgcuguagggagccugugcug

SEQ ID NO: 553 - RNA, 96 nt, Homo sapiens
gugacccugggcaaguuccugaagaucagacacaucagaucccuuaucuguaaaaugggcaugauccaggaaccugccucuacgguugccuugggg

SEQ ID NO: 554 - RNA, 99 nt, Homo sapiens
ugggugaaaggaaggaaagacauaggauagagucaccucuguccucuguccucuaccuauagaggugacuguccuaugucuuuccuuccucuuaccccu

SEQ ID NO: 555 - RNA, 97 nt, Homo sapiens
aucugaguugggagggucccucuccaaaugugucuuggggugggggaucaagacacauuuggagagggaaccucccaacucggccucugccaucauu

SEQ ID NO: 556 - RNA, 77 nt, Homo sapiens
gaguugggagguucccucuccaaaugugucuugaucccccaccccaagacacauuuggagagggacccucccaacuc

SEQ ID NO: 557 - RNA, 97 nt, Homo sapiens
accaagugauauucauugucuaccugagcuagaauacaaguaguuggcgucuucagagacacuuguaugcuagcucagguagauauugaaugaaaaa

SEQ ID NO: 558 - RNA, 94 nt, Homo sapiens
uuuuuuuuuaguauuuuuccaucaguguucauaaggaauguugcucuguaguuuucuuauaguguggcuuucuuagagcaaagaugguucccua

SEQ ID NO: 559 - RNA, 94 nt, Homo sapiens
caguuccuaacaggccucagaccaguaccggucuguggccuggggguugaggaccccugcucuaggcugguacugcugaugcuuaaaaagagag

SEQ ID NO: 560 - RNA, 94 nt, Homo sapiens
gaucaggagucugccaguggagucagcacaccugcuuuucaccugugaucccaggagaggaagcagcugccucugaggccucaggcucaguggc

SEQ ID NO: 561 - RNA, 96 nt, Homo sapiens
aggaaguguuggccuguggcugcacucacuuccuucagccccaggaagccuuggucgggggcaggagggagggucaggcagggcugggggccugac

SEQ ID NO: 562 - RNA, 94 nt, Homo sapiens
aucacagacaccuccaagugugcagggcacuggugggggccggggcaggcccagcgaaagugcaggaccuggcacuuagucggaagugagggug

SEQ ID NO: 563 - RNA, 97 nt, Homo sapiens
ggccuagccaaauacuguauuuuugaucgacauuugguugaaaaauaucuauguauuaguaaaccuguguuguucaagaguccacuguguuuugcug

SEQ ID NO: 564 - RNA, 96 nt, Homo sapiens
cagugcuggggucucaggaggcagcgcucucaggacgucaccaccauggccugggcucugcuccuccucacccuccucacucagggcacaggugau

SEQ ID NO: 565 - RNA, 97 nt, Homo sapiens
aaucuaucacugcuuuuuaggauaagcuugacuuuuguucaaauaaaaaugcaaaaggaaaguguauccuaaaaggcaaugacaguuuaauguguuu

SEQ ID NO: 566 - RNA, 98 nt, Homo sapiens
acgaauggcuaugcacugcacaacccuaggagagggugccauucacauagacuauaauugaauggcgccacuaggguugugcagugcacaaccuacac

SEQ ID NO: 567 - RNA, 96 nt, Homo sapiens
uucauuccuucaguguugaaacaaucucuacugaaccagcuucaaacaaguucacuggaguuuguuucaauauugcaagaaugauaagauggaagc

SEQ ID NO: 568 - RNA, 81 nt, Homo sapiens
ggguaaguggaaagauggugggccgcagaacaugugcugaguucgugccauaugucugcugaccaucaccuuuagaagccc

SEQ ID NO: 569 - RNA, 97 nt, Homo sapiens
aacuaugcaaggauauuugaggagagguuauccguguuauguucgcuucauucaucaugaauaauacaugguuaaccucuuuuugaauaucagacuc

SEQ ID NO: 570 - RNA, 78 nt, Homo sapiens
cugaaauagguugccugugagguguucacuuucuauaugaugaauauuauacagucaaccucuuuccgauaucgaauc

SEQ ID NO: 571 - RNA, 98 nt, Homo sapiens
guguaguagagcuaggaggagaggguccuggagaagcguggaccgguccggguggguuccggcagguucucacccucucuaggccccauucuccucug

SEQ ID NO: 572 - RNA, 100 nt, Homo sapiens
gcucgguugccgugguugcgggcccugcccgcccgccagcucgcugacagcacgacucagggcggagggaaguagguccguuggucggucgggaacgagg

SEQ ID NO: 573 - RNA, 97 nt, Homo sapiens
uaccgacccucgauuugguucaggaccuucccugaaccaaggaagagucacagucucuuccuugguucagggaggguccccaacaauguccucaugg

SEQ ID NO: 574 - RNA, 97 nt, Homo sapiens
cugcuccuucucccauacccauugcauaucggaguugugaauucucaaaacaccuccugugugcauggauuacaggagggugagccuugucaucgug

SEQ ID NO: 575 - RNA, 89 nt, Homo sapiens
ggagaggcugugcuguggggcaggcgcaggccugagcccugguuucgggcugccugggucucuggccugcgcgugacuuugggguggcu

SEQ ID NO: 576 - RNA, 95 nt, Homo sapiens
gcuguugaggcugcgcagccaggcccugacggugggguggcugcgggccuucugaaggucucccacguuguggcccagcagcgcagucacguugc

SEQ ID NO: 577 - RNA, 93 nt, Homo sapiens
ccuuccggcgucccaggcggggcgccgcgggaccgcccucgugucuguggcggugggaucccgcggccguguuuuccugguggcccggccaug

SEQ ID NO: 578 - RNA, 115 nt, Homo sapiens
ggugccgagggccguccggcauccuaggcgggucgcugcgguaccucccuccugucuguggcggugggaucccguggccguguuuuccugguggcccggccgugccugagguuuc

SEQ ID NO: 579 - RNA, 82 nt, Homo sapiens
gaacauugaaacuggcuagggaaaaugauuggauagaaacuauuauucuauucauuuauccccagccuacaaaaugaaaaaa

SEQ ID NO: 580 - RNA, 61 nt, Homo sapiens
ugggcuaagggagaugauuggguagaaaguauuauucuauucauuugccucccagccuaca

SEQ ID NO: 581 - RNA, 72 nt, Homo sapiens
ucuccucgaggggucucugccucuacccaggacucuuucaugaccaggaggcugaggccccucacaggcggc

SEQ ID NO: 582 - RNA, 66 nt, Homo sapiens
gguaagugcgccucgggugagcaugcacuuaauguggguguaugucacucggcucggcccacuacc

SEQ ID NO: 583 - RNA, 98 nt, Homo sapiens
guuuagggguggaccugaugucccugaguguauguggugaaccugaauuugccuuggguuuccucauauucauucaggagugucaguugccccuucac

SEQ ID NO: 584 - RNA, 118 nt, Homo sapiens
gcaggugaacuggcaggccaggaagaggaggaagcccuggaggggcuggaggugauggauguuuuccuccgguucucagggcuccaccucuuucgggccguagagccagggcuggugc

SEQ ID NO: 585 - RNA, 73 nt, Homo sapiens
cccagggucuggugcggagagggcccacaguggacuuggugacgcuguaugcccucaccgcucagccccuggg

SEQ ID NO: 586 - RNA, 67 nt, Homo sapiens
gcaugacucuucaaccucaggacuugcagaauuaauggaaugcuguccuaagguuguugaguugugc

SEQ ID NO: 587 - RNA, 88 nt, Homo sapiens
aacugcccucaaggagcuuacaaucuagcuggggguaaaugacuugcacaugaacacaacuagacugugagcuucuagagggcaggga

SEQ ID NO: 588 - RNA, 76 nt, Homo sapiens
acugacuuugagucucuccucagggugcugcaggcaaagcuggggacccagggagagacguaagugaggggagaug

SEQ ID NO: 589 - RNA, 70 nt, Homo sapiens
ggccgcggcgcgcaagauggcggcgggcccgggcaccgccccuuccgccccgccgggcgucgcacgaggc

SEQ ID NO: 590 - RNA, 98 nt, Homo sapiens
uugggcaaggugcggggcuagggcuaacagcagucuuacugaagguuuccuggaaaccacgcacaugcuguugccacuaaccucaaccuuacucgguc

SEQ ID NO: 591 - RNA, 88 nt, Homo sapiens
gccuggauacaugagaugguugaccagagagcacacgcuuuauuugugccguuugugaccugguccacuaacccucaguaucuaaugc

SEQ ID NO: 592 - RNA, 91 nt, Homo sapiens
uaauaaauuaaaugccuaaacuggcagagugcaaacaauuuugacucagaucuaaauguuugcacuggcuguuuaaacauuuaauuuguua

SEQ ID NO: 593 - RNA, 80 nt, Homo sapiens
ggcgcgucgccccccucaguccaccagagcccggauaccucagaaauucggcucugggucuguggggagcgaaaugcaac

SEQ ID NO: 594 - RNA, 59 nt, Homo sapiens
ggaggagcagcagggugaaacugacacaguucuggugaguuucacuuugcugcuccucc

SEQ ID NO: 595 - RNA, 83 nt, Homo sapiens
ggcccggcuccgggucucggcccguacaguccggccggccaugcuggcggggcuggggccggggccgagcccgcggcggggcc

SEQ ID NO: 596 - RNA, 85 nt, Homo sapiens
aaucuaggaggcaggugcucacuuguccuccuccaugcuuggaaaaugcagggaggaggccauaguggcaacuguuaccaugauu

SEQ ID NO: 597 - RNA, 114 nt, Homo sapiens
uuuaggcgcugaugaaaguggaguucaguagacagcccuuuucaagcccuacgagaaacugggguuucuggaggagaaggaaggugaugaaggaucuguucucgugagccugaa

SEQ ID NO: 598 - RNA, 111 nt, Homo sapiens
gcauccucaggaccugggcuugggugguaggaggaauuggugcuggucuuucauuuuggauuugacuccagccccacagccucagccaccccagccaauugucauaggagc

SEQ ID NO: 599 - RNA, 109 nt, Homo sapiens
gcuuuuauauuguagguuuuugcucaugcaccaugguugucugagcaugcagcaugcuugucugcucauaccccaugguuucugagcaggaaccuucauugucuacugc

SEQ ID NO: 600 - RNA, 118 nt, Homo sapiens
gccuuggugcugauuccugggcucugaccugagaccucuggguucugagcugugauguugcucucgagcugggaucuccggggucuugguucagggccggggccucuggguuccaagc

SEQ ID NO: 601 - RNA, 98 nt, Homo sapiens
aggagccaccuuccgagccuccaguaccacgugucagggccacaugagcugggccucgugggccugauguggugcuggggccucaggggucugcucuu

SEQ ID NO: 602 - RNA, 94 nt, Homo sapiens
guucuguuauuugcagucaguaacaaagauucauccuuguguccaucaugcaacaaggagaaucuuugucacuuaguguaauuaauagcuggac

SEQ ID NO: 603 - RNA, 77 nt, Homo sapiens
gugugcauuugcaggaacuugugagucuccuauugaaaaugaacaggagacugaugaguucccgggaacacccacaa

SEQ ID NO: 604 - RNA, 78 nt, Homo sapiens
uuagcccugcggccccacgcaccaggguaagagagacucucgcuuccugcccuggcccgagggaccgacuggcugggc

SEQ ID NO: 605 - RNA, 76 nt, Homo sapiens
uuagugguacuauaccucaguuuuaucagguguucuuaaaaucaccuggaaacacugagguugugucucacugaac

SEQ ID NO: 606 - RNA, 81 nt, Homo sapiens
ugaagugcuguggauuucuuugugaaucaccauaucuaagcuaaugugguggugguuuacaaaguaauucauagugcuuca

SEQ ID NO: 607 - RNA, 86 nt, Homo sapiens
guagaggagauggcgcaggggacacgggcaaagacuuggggguuccugggacccucagacguguguccucuucucccuccucccag

SEQ ID NO: 608 - RNA, 74 nt, Homo sapiens
ccgcacucucuccauuacacuacccugccucuucuccaugagaggcagcgggguguaguggauagagcacgggu

SEQ ID NO: 609 - RNA, 79 nt, Homo sapiens
gugcagauccuugggagcccuguuagacucuggauuuuacacuuggagugaacgggcgccaucccgaggcuuugcacag

SEQ ID NO: 610 - RNA, 77 nt, Homo sapiens
ggcagugcucuacucaaaaagcugucagucacuuagauuacaugugacugacaccucuuugggugaaggaaggcuca

SEQ ID NO: 611 - RNA, 79 nt, Homo sapiens
gugcuuaaagaauggcuguccguaguauggucucuauauuuaugaugauuaauaucggacaaccauuguuuuaguaucc

SEQ ID NO: 612 - RNA, 77 nt, Homo sapiens
ggaagugcccuacuuggaaaggcaucaguugcuuagauuacauguaacuauucccuuucugaguagaguaagucuua

SEQ ID NO: 613 - RNA, 79 nt, Homo sapiens
ccuuaauccuugcaacgaaccugagccacugauucaguaaaauacucaguggcacauguuuguugugagggucaaaaga

SEQ ID NO: 614 - RNA, 79 nt, Homo sapiens
ccuuaauccuugcaacuuaccugagucauugauucaguaaaacauucaauggcacauguuuguuguuagggucaaaaga

SEQ ID NO: 615 - RNA, 75 nt, Homo sapiens
gcagugccuuacucagaaaggugccagucacuuacacuacaugucacuguguccuuucugcguagaguaaggcuc

SEQ ID NO: 616 - RNA, 77 nt, Homo sapiens
ugcaaugcccuacucagaaaggugccauuuauguagauuuuaugucacuggcuccuuucuggguagagcaaggcuca

SEQ ID NO: 617 - RNA, 77 nt, Homo sapiens
ggcagugcccuauucagaaaggugccagucacuuagauuacaugucacuguuuccuuucugaguggaguagggcuua

SEQ ID NO: 618 - RNA, 75 nt, Homo sapiens
guaguuguucuacagaagaccuggauguguaggagcuaagacacacuccaggggagcuguggaagcaguaacacg

SEQ ID NO: 619 - RNA, 56 nt, Homo sapiens
acuagugagggacagaaccaggauucagacucagguccaugggccuggaucacugg

SEQ ID NO: 620 - RNA, 81 nt, Homo sapiens
auggcguuuucccucucccuguccuggacuggggucagacugugccccgaggagaagcagcagagaauaggacuacgucau

SEQ ID NO: 621 - RNA, 53 nt, Homo sapiens
aauagagucuugugaugucuugcuuaagggccauccaaccuagagucuacaac

SEQ ID NO: 622 - RNA, 77 nt, Homo sapiens
acuugggucaguucagagguccucggggcgcgcgucgagucagccgugugcgcagggagaccucucccacccacagu

SEQ ID NO: 623 - RNA, 83 nt, Homo sapiens
agaaauaaggcuucugucuacuacuggagacacugguaguauaaaacccagagucuccaguaauggacgggagccuuauuucu

SEQ ID NO: 624 - RNA, 91 nt, Homo sapiens
ggcgggggcgcgggcggcaguggcgggagcggccccucggccauccuccgucugcccaguuaccgcuuccgcuaccgccgccgcucccgcu

SEQ ID NO: 625 - RNA, 98 nt, Homo sapiens
ucaaggccacugggacaguagagggaggaaucgcagaaaucacuccaggagcaacugagagaccuugcuucuacuuuaccagguccugcuggcccaga

SEQ ID NO: 626 - RNA, 86 nt, Homo sapiens
agcacugcccccggugagucaggguggggcuggcccccugcuucgugcccauccgcgcucugacucucugcccaccugcaggagcu

SEQ ID NO: 627 - RNA, 83 nt, Homo sapiens
gaagguguaccaugugcccuuaaaggugaacccagugcaccuucaugaaccgugguacaccuuuaagaacuugguaugccuuc

SEQ ID NO: 628 - RNA, 82 nt, Homo sapiens
ugugggcagggcccuggggagcugaggcucuggggguggccggggcugacccugggccucugcuccccagugucugaccgcg

SEQ ID NO: 629 - RNA, 94 nt, Homo sapiens
gugaggugugggcccggccccaggagcggggccugggcagccccguguguugaggaaggaaggcagggcccccgcuccccgggccugaccccac

SEQ ID NO: 630 - RNA, 72 nt, Homo sapiens
uguggacaugugcccagggcccgggacagcgccacggaagaggacgcacccggcugugugcacaugugccca

SEQ ID NO: 631 - RNA, 72 nt, Homo sapiens
ugugcacaugugcccagggcccgggacagcgccacggaagaggacgcacccggcugugugcacaugugccca

SEQ ID NO: 632 - RNA, 72 nt, Homo sapiens; identical to SEQ ID NO: 631

SEQ ID NO: 633 - RNA, 72 nt, Homo sapiens; identical to SEQ ID NO: 631

SEQ ID NO: 634 - RNA, 86 nt, Homo sapiens
auuaggagaguaucuucucuguuuuggccauguguguacucacagccccucacacauggccgaaacagagaaguuacuuuccuaau

SEQ ID NO: 635 - RNA, 94 nt, Homo sapiens
gggacguucugagcucggggugggggacguuugccggucacugcugcuggcgcccugacuguugccguccuccagccccacucaaaggcauccc

SEQ ID NO: 636 - RNA, 88 nt, Homo sapiens
guuccagacacaucucaucugauauacaauauuuucuuaaauuguauaaagagaaauuauuguacaucggaugagcugugucugggau

SEQ ID NO: 637 - RNA, 91 nt, Homo sapiens
gcguuggcuggcagaggaagggaaggguccagggucagcugagcaugcccucagguugcucacuguucuucccuagaaugucaggugaugu

SEQ ID NO: 638 - RNA, 91 nt, Homo sapiens
ggcuggaaaggaagaagcauucuuucauugguugguguguauugccuugucaaccaauaagaggaugccauuuauccuuuucugacuagcu

SEQ ID NO: 639 - RNA, 69 nt, Homo sapiens
gcugcuggacccacccggccgggaauagugcuccugguuguuuccggcucgcgugggugugucggcggc

SEQ ID NO: 640 - RNA, 81 nt, Homo sapiens
uccacugcugccgccgucgccgccacccgagccggagcgggcugggccgccaaggcaagaugguggacuacagcguguggg

SEQ ID NO: 641 - RNA, 97 nt, Homo sapiens
gggacuugucacugccugucuccucccucuccagcagcgacuggauucuggaguccaucuagagggucuugggagggaugugacuguugggaagccc

SEQ ID NO: 642 - RNA, 89 nt, Homo sapiens
auuauucaaaugcucggagacacagaacauuagagaagacaggaguucacuguaggugauggugagagugggcauggagcaggagugcc

SEQ ID NO: 643 - RNA, 99 nt, Homo sapiens
cuugcagaacgaggugaaggaggugguucugcucagcagucaacaguggccacaucuccaccugcagcgacuugauggcuuccguguccuuuucguggg

SEQ ID NO: 644 - RNA, 99 nt, Homo sapiens; identical to SEQ ID NO: 643

SEQ ID NO: 645 - RNA, 99 nt, Homo sapiens; identical to SEQ ID NO: 643

SEQ ID NO: 646 - RNA, 86 nt, Homo sapiens
uuugguacuugaagagaggauacccuuuguauguucacuugauuaauggcgaauauacagggggagacucuuauuugcguaucaaa

SEQ ID NO: 647 - RNA, 86 nt, Homo sapiens
uuugguacuuaaagagaggauacccuuuguauguucacuugauuaauggcgaauauacagggggagacucucauuugcguaucaaa

SEQ ID NO: 648 - RNA, 78 nt, Homo sapiens
guagcugaggggaugguagaccggugacgugcacuucauuuacgauguaggucacccguuugacuauccaccagcgcc

SEQ ID NO: 649 - RNA, 88 nt, Homo sapiens
acuuccugguauuugaagaugcgguugaccaugguguguacgcuuuauuugugacguaggacacauggucuacuucuucucaauauca

SEQ ID NO: 650 - RNA, 119 nt, Homo sapiens
agccugcgccggagccggggccugagcccgggccgcgcaggccgugaacucgucgagcugcgcgugcggccggugcucaaccugccggguccuggccccgcgcucccgcgcgcccugga

SEQ ID NO: 651 - RNA, 76 nt, Homo sapiens
ugcuacuucuccugagccauucugagccucaaucacuugccagagagauugguucaggaauuugucagggauagcc

SEQ ID NO: 652 - RNA, 83 nt, Homo sapiens
ccugcugcagaggugccagcugcagugggggaggcacugccagggcugcccacucugcuuagccagcaggugccaagaacagg

SEQ ID NO: 653 - RNA, 85 nt, Homo sapiens
uccuccccggagccaggaugcagcucaagccacagcaggguguuuagcgcucuucaguggcuccagauuguggcgcuggugcagg

SEQ ID NO: 654 - RNA, 67 nt, Homo sapiens
accucguggccuggucuccauuauuugagaugaguuacaucuuggaggugaggacgugccucguggu

SEQ ID NO: 655 - RNA, 63 nt, Homo sapiens
gaaggccucugcaggguuugcuuugagguacuuccuuccugucaacccuguucuggagucugu

SEQ ID NO: 656 - RNA, 59 nt, Homo sapiens
caguguucauguagauguuuaagcucuugcaguagguuuuugcaagcuagugaacgcug

SEQ ID NO: 657 - RNA, 87 nt, Homo sapiens
gcagggcuggcagggaggcugggaggggcuggcugggucugguagugggcaucagcuggcccucauuucuuaagacagcacuucugu

SEQ ID NO: 658 - RNA, 73 nt, Homo sapiens
caccggcagaaucacuguucagacaggcggagacgggucuuucucgcccucugaugagucaccacuguggugg

SEQ ID NO: 659 - RNA, 85 nt, Homo sapiens
gugaggacucgggagguggaggguggugccgccggggccgggcgcuguuucagcucgcuucuccccccaccuccucucuccucag

SEQ ID NO: 660 - RNA, 90 nt, Homo sapiens
guggguacggcccagugggggggagagggacacgcccugggcucugcccagggugcagccggacugacugagccccugugccgcccccag

SEQ ID NO: 661 - RNA, 75 nt, Homo sapiens
gugagggcaugcaggccuggauggggcagcugggaugguccaaaaggguggccucaccagcccuguguucccuag

SEQ ID NO: 662 - RNA, 88 nt, Homo sapiens
guggggccaggcgguggugggcacugcuggggugggcacagcagccaugcagagcgggcauuugaccccgugccacccuuuuccccag

SEQ ID NO: 663 - RNA, 73 nt, Homo sapiens
gugggcgggggcagguguguggugggugguggccugcggugagcagggcccucacaccugccucgccccccag

SEQ ID NO: 664 - RNA, 69 nt, Homo sapiens
guggguaggguuugggggagagcgugggcugggguucagggacacccucucaccacugcccucccacag

SEQ ID NO: 665 - RNA, 92 nt, Homo sapiens
gucagugucugggcggacagcugcaggaaagggaagaccaaggcuugcugucuguccagucugccacccuacccugucuguucuugccacag

SEQ ID NO: 666 - RNA, 82 nt, Homo sapiens
gugagugggaggccagggcacggcagggggagcugcagggcuaugggaggggccccagcgucugagcccuguccucccgcag

SEQ ID NO: 667 - RNA, 82 nt, Homo sapiens; identical to SEQ ID NO: 666

SEQ ID NO: 668 - RNA, 84 nt, Homo sapiens
gugagugugggguggcuggggggggggggggggggccggggacggcuugggccugccuagucggccugaccacccaccccacag

SEQ ID NO: 669 - RNA, 102 nt, Homo sapiens
gugagugacaggggaaauggggauggacuggaagugggcagcauggagcugaccuucaucauggcuuggccaacauaaugccucuuccccuugucucuccag

SEQ ID NO: 670 - RNA, 102 nt, Homo sapiens
gugggagggcccaggcgcgggcagggguggggguggcagagcgcugucccgggggcggggccgaagcgcggcgaccguaacuccuucugcuccgucccccag

SEQ ID NO: 671 - RNA, 83 nt, Homo sapiens
gugagugggagccccagugugugguuggggccauggcgggugggcagcccagccucugagccuuccucgucugucugccccag

SEQ ID NO: 672 - RNA, 93 nt, Homo sapiens
cuaaaacuggaucaauuauaggagugaaauaaagguccaucuccugccuauuuauuacuuugcuuugguaauaaaucuauuuuuaaaagaacc

SEQ ID NO: 673 - RNA, 85 nt, Homo sapiens
aucuuauuccgagcauuccaguaacuuuuuuguguauguacuuagcuguacuauaaguaguugguuuguaugagaugguuaaaaa

SEQ ID NO: 674 - RNA, 85 nt, Homo sapiens; identical to SEQ ID NO: 673

SEQ ID NO: 675 - RNA, 85 nt, Homo sapiens; identical to SEQ ID NO: 673

SEQ ID NO: 676 - RNA, 70 nt, Homo sapiens
auuuauguauaggccuuuagaucaucugauguugaauacucuuuaagugaucuaaaggccuacauauaaa

SEQ ID NO: 677 - RNA, 69 nt, Homo sapiens
uuuauauguaggccuuuagaucacuuaaagaguauucaacaucagaugaucuaaaggccuauacauaaa

SEQ ID NO: 678 - RNA, 73 nt, Homo sapiens
uguauccuugaauggauuuuuggagcaggaguggacaccugacccaaaggaaaucaauccauaggcuagcaau

SEQ ID NO: 679 - RNA, 136 nt, Homo sapiens
ccgcuugccucgcccagcgcagccccggccgcugggcgcacccgucccguucguccccggacguugcucucuaccccgggaacgucgagacuggagcgcccgaacugagccaccuucgcggaccccgagagcggcg

SEQ ID NO: 680 - RNA, 106 nt, Homo sapiens
uuuaccuucuuguauaagcacugugcuaaaauugcagacacuaggaccaugucuugguuuuugcaauaaugcuagcagaguacacacaagaagaaaaguaacagca

SEQ ID NO: 681 - RNA, 66 nt, Homo sapiens
gggaggagggaggagaugggccaaguucccucuggcuggaacgcccuucccccccuucuucaccug

SEQ ID NO: 682 - RNA, 113 nt, Homo sapiens
cugucccgcuggccuggcaggugacggugcuggauguggccuuuuugccuuuucuaaaggccacauuuuccagcccauucaaccuuccagagcccucugaaguggccacaggc

SEQ ID NO: 683 - RNA, 70 nt, Homo sapiens
guggacucuagcugccaaaggcgcuucuccuucugaacagagcgcuuugcucagccaguguagacauggc

SEQ ID NO: 684 - RNA, 65 nt, Homo sapiens
agaaagaaggaaauugaauucauuuagaaaagagaauuccaaaugagcuuaauuuccuuuuuucu

SEQ ID NO: 685 - RNA, 105 nt, Homo sapiens
agcagcaagagauagaauccaaaagagaagaagaucagccugcagauguggacugcuaaaugcaggcugaucuucuccccuuugggauucucuuaugagaagcca

SEQ ID NO: 686 - RNA, 97 nt, Homo sapiens
ggugggaggauugcuugagccuggaagcuggagccugcagugaacuaucauugugccacuguacuccagccuaggcaacaaaaugaaauccugucua

SEQ ID NO: 687 - RNA, 63 nt, Homo sapiens
cugagccuggaagcuggagccugcagugagcuaugaucaugucccuguacucuagccugggca

SEQ ID NO: 688 - RNA, 113 nt, Homo sapiens
auuggaaauccuuugaguugcuucucaaggaugagcaaagaaaguagauuuuuuagauucuaaagaaacuaucuucuuugcucauccuugagaagcaacuccuuauccauuaa

SEQ ID NO: 689 - RNA, 63 nt, Homo sapiens
uacggaugagcaaagaaagugguuucuuaaaauggaaucuacucuuugugaagaugcugugaa

SEQ ID NO: 690 - RNA, 67 nt, Homo sapiens
ucuuacggaugagcaaagaaagugguuugcgccucaagaaaccacuuucuuugcucauccauaagga

SEQ ID NO: 691 - RNA, 119 nt, Homo sapiens
agucagccuguugaagcuuugaagcuuugaugccaggcauugacuucucacuagcugugaaaguccuagcuaaagagaagucaaugcaugacaucuuguuucaauagauggcuguuuca

SEQ ID NO: 692 - RNA, 117 nt, Homo sapiens
gcccugggcuugugcuuggggagugaaugauggguucugacccccaugcaccccugugggccccuggcaucacuggccccauccuucaccccugccaaccacgcuugcccugugccu

SEQ ID NO: 693 - RNA, 73 nt, Homo sapiens
cuguggcuuccacgaccuaauccuaacuccugcgagucccuggaguuaggauuaggucguggaagccacagga

SEQ ID NO: 694 - RNA, 73 nt, Homo sapiens
accuuuccagcucaucccaccucugccaccaaaacacucaucgcggggucagagggagugccaaaaaagguaa

SEQ ID NO: 695 - RNA, 89 nt, Homo sapiens
ucuccguuuaucccaccacugccaccauuauugcuacuguucagcaggugcugcugguggugauggugauagucuggugggggcggugg

SEQ ID NO: 696 - RNA, 82 nt, Homo sapiens
ugcuauggauaaggcuuuggcuuauggggauauugugguugaucuguucuauccagaugacugaaacuuucuccauagcagc

SEQ ID NO: 697 - RNA, 93 nt, Homo sapiens
aucuacaauggugaugggugaauuuguagaaggaugaaagucaaagaauccuucugggaacuaauuuuuggccuucaacaagaauugugauau

SEQ ID NO: 698 - RNA, 86 nt, Homo sapiens
cuaccccaaaauaugguacccuggcauacugaguauuuuaauacuggcauacucaguaugccauguugccauauuuugggguagca

SEQ ID NO: 699 - RNA, 69 nt, Homo sapiens
agguccucaauaaguauuuguugaaagaauaaauaaaccaacaagucuuauuugagcaccuguuaugug

SEQ ID NO: 700 - RNA, 86 nt, Homo sapiens
augguuugggacucaggauguggucaaguguuguuaaggcauguucaggaacaauacuugaccacauuuugaauuccaaaccauau

SEQ ID NO: 701 - RNA, 84 nt, Homo sapiens
acagguagugucccucagggcuguagaacagggcugggauuacuaaagcccuguucuaugcccugagggacacugagcauguca

SEQ ID NO: 702 - RNA, 78 nt, Homo sapiens
cucccaaaucuccuguugaaguguaauccccaccuccagcauuggggauuacauuucaacaugagauuuggaugagga

SEQ ID NO: 703 - RNA, 52 nt, Homo sapiens
uagccgggcgugguggugggggccuguggucccagcuacuuuggaggcugag

SEQ ID NO: 704 - RNA, 50 nt, Homo sapiens
acccgggcgugguggugggggugggugccuguaauuccagcuaguuggga

SEQ ID NO: 705 - RNA, 105 nt, Homo sapiens
uggauugccuagaccagggaagccaguuggcauggcucaguccaagucugaccaccugaggaaugccuggacugagccgugcuacuggcuucccuggucuccagc

SEQ ID NO: 706 - RNA, 75 nt, Homo sapiens
ugagguuucuggacugagccaugcuacuggcuucucugguucuccagcuuacagauggcuuaucaugggaccucu

SEQ ID NO: 707 - RNA, 83 nt, Homo sapiens
cacagaguuauacuggagauauggaagagcuguguuggguauaaguaacaggcuuuucuuuaucuucuauguggcucuuugca

SEQ ID NO: 708 - RNA, 83 nt, Homo sapiens; identical to SEQ ID NO: 707

SEQ ID NO: 709 - RNA, 86 nt, Homo sapiens
cacccagaucagugcuuggcaccuagcaagcacucaguaaauauuuguugagugccugcuaugugccaggcauugugcugagggcu

SEQ ID NO: 710 - RNA, 129 nt, Homo sapiens
ccagaucagaucugggugcgaugaugauggcagcaaauucugaaaacgugcucagugucuuuauaacaggaaagccguaaacuuagaaauguaggcugcagcucgugugcucuguggucugggcuggua

SEQ ID NO: 711 - RNA, 103 nt, Homo sapiens
ugaggcaggagaauugcuugaacccgggugguggagguugcagugagccaagauugcgccacugcacuccagccugggcgacaaagcaagacucuuucuugga

SEQ ID NO: 712 - RNA, 77 nt, Homo sapiens
ugcagccugggcgacaaaacgagacccugucuuuuuuuuuuucugagacagagucucguucuguugcccaagcugga

SEQ ID NO: 713 - RNA, 86 nt, Homo sapiens
gaaucgcuugaacccaugagguugaggcugcagugagccaagaucgugccacugcacuucagccugggugacaagagcgaaacuuc

SEQ ID NO: 714 - RNA, 102 nt, Homo sapiens
ugaggcaggagaauugcuugaacccaggaaguggaggcugcagugagccgagaucgagccacuguacuccagccugggugacacagcgagacuccagucuca

SEQ ID NO: 715 - RNA, 99 nt, Homo sapiens
aggugggaggauugcuugagccugggagauggagguugcagugagcugagaucacgcaacugcacccccagccugggccauagagucaguccuugucuc

SEQ ID NO: 716 - RNA, 100 nt, Homo sapiens
gaggugggaggauugcuugagucagggugguugaggcugcaguaaguugugaucauaccacugcacuccagccugagugacagagcaagaccuugucuca

SEQ ID NO: 717 - RNA, 116 nt, Homo sapiens
uacuugggugacuaaggcaggauugcuugagccugggaggucaaggcugcagugucguggucacagcuugcugcagacucgaccucccaggcuuaagcaauccuccugcucgagug

SEQ ID NO: 718 - RNA, 80 nt, Homo sapiens
ccucugugagaaagggugugggggagaggcugucuugugucuguaaguaugccaaacuuauuuuccccaaggcagaggga

SEQ ID NO: 719 - RNA, 83 nt, Homo sapiens
ccccagcuagguaaagagcccuguggagacaccuggauucagagaacaugucuccacugagcacuugggccuugauggcggcu

SEQ ID NO: 720 - RNA, 78 nt, Homo sapiens
accucccaaauauauauauauauguacguauguguauauaaauguauacguagauauauauguauuuuugguggguuu

SEQ ID NO: 721 - RNA, 81 nt, Homo sapiens
auuugcucauagaugauaugcauaguacucccagaacucauuaaguugguaguacugugcauaucaucuaugagcgaauag

SEQ ID NO: 722 - RNA, 62 nt, Homo sapiens
auauucacaaaaauucauauugcuucuuucuaaugccaagaaagaagaguauaagaacuucc

SEQ ID NO: 723 - RNA, 54 nt, Homo sapiens
agggggcaccgggaggaggugagugucucuugucgccuccuccucuccccccuu

SEQ ID NO: 724 - RNA, 101 nt, Homo sapiens
ccuucuucucguuugccuuuuucugcuucugcugcaugaucuccgagucccuggggguagagaugauggggcacugggagguaccagagggcaaaaaggac

SEQ ID NO: 725 - RNA, 87 nt, Homo sapiens
cucaagcuaugagucuacaaaggaaagcgcuuucuguugucagaaagaagagaaagcgcuucccuuuugaggguuacgguuugagaa

SEQ ID NO: 726 - RNA, 87 nt, Homo sapiens
cucaagcugugagucuacaaaggaaagcgcuuucuguugucugaaagaaaagaaaucgcuucccuuuggaguguuacgguuugagaa

SEQ ID NO: 727 - RNA, 120 nt, Homo sapiens
auuuugauauauaagccaguuuaauguuuucuauacagacccuggcuuuucuuaaauuuuauauauuggaaagcccauguuuguauuggaaacugcugguuucuuucauacugaaaaucu

SEQ ID NO: 728 - RNA, 84 nt, Homo sapiens
uguagagauaggaucucacuuuguugcccaggcuggucucaaacuccuggucugggcaacaaagugagaccuuaucucuacaag

SEQ ID NO: 729 - RNA, 88 nt, Homo sapiens
uuugggaggccgaggcuggugcaucacuugagcccagcaauuugagaccaaucugggcaacaaagugagaccuccgucucuacaaaga

SEQ ID NO: 730 - RNA, 78 nt, Homo sapiens
uguccucuggggacucagcuugcucuggcugcuggauugaauuagcugcaggaccaagaugagcccuugguggagaca

SEQ ID NO: 731 - RNA, 90 nt, Homo sapiens
guugugcuguccaggugcuggaucagugguucgagucugagccuuuaaaagccacucuagccacagaugcagugauuggagccaugacaa

SEQ ID NO: 732 - RNA, 75 nt, Homo sapiens
gaggguguugaucagcagaucaggacuguaacucaccauagugguggacugcccugaucuggagaccacugccuu

SEQ ID NO: 733 - RNA, 144 nt, Homo sapiens
uucucaauuuuuaguaggaauuaaaaacaaaacugguaaaugcagacucuugguuuccacccccagagaaucccuaaaccggggguggaguccaggaaucugcauuuuagaaaguacccagggugauucugauaauugggaaca

SEQ ID NO: 734 - RNA, 111 nt, Homo sapiens
ccacgguccuaguuaaaaaggcacauuccuagacccugccucagaacuacugaacagagucacuggguguggaguccaggaaucugcauuuuuaccccuaucgcccccgcc

SEQ ID NO: 735 - RNA, 78 nt, Homo sapiens
gagcgucacguugacacucaaaaaguuucagauuuuggaacauuucggauuuuggauuuuuggaucagggaugcucaa

SEQ ID NO: 736 - RNA, 87 nt, Homo sapiens
gguagaauuccaguggcccugacugaagaccagcaguuguacuguggcuguugguuucaagcagaggccuaaaggacugucuuccug

SEQ ID NO: 737 - RNA, 66 nt, Homo sapiens
ccugggaacggguuccggcagacgcugagguugcguugacgcucgcgccccggcucccguuccagg

SEQ ID NO: 738 - RNA, 71 nt, Homo sapiens
agguuguucuggguggucuggagauuugugcagcuuguaccugcacaaaucuccggaccacuuagucuuua

SEQ ID NO: 739 - RNA, 142 nt, Homo sapiens
caccuaaugugugccaagaucuguucauuuaugaucucaccgaguccugugagguuggcauuguugucuggcauugucugauauacaacagugccaaccucacaggacucagugaggugaaacugaggauuaggaaggugua

SEQ ID NO: 740 - RNA, 79 nt, Homo sapiens
aggacauuuugcccagauccguggccuauucagaaauguggccugugauuaggccgcagaucugggugaaauguccucc

SEQ ID NO: 741 - RNA, 60 nt, Homo sapiens
cacccagaucugcggccuaaucacaggccacauuucugaauaggccacggaucugggcaa

SEQ ID NO: 742 - RNA, 92 nt, Homo sapiens
accuaccuaacuggguuagggcccuggcuccaucuccuuuaggaaaaccuucuguggggaguggggcuucgacccuaacccaggugggcugu

SEQ ID NO: 743 - RNA, 77 nt, Homo sapiens
uguuuaucucuaggguugaucuauuagaauuacuuaucugagccaaaguaauucaaguaauucagguguagugaaac

SEQ ID NO: 744 - RNA, 112 nt, Homo sapiens
agacgaggaguuaagaguucauucggcuguccagauguauccaaguacccuguguuauuuggcaauaaauacaucugggcaacugacugaacuuuucacuuuucaugacuca

SEQ ID NO: 745 - RNA, 83 nt, Homo sapiens
ccucauggcaguguucuggaauccuacgugagggacaaucauucagacccacguagcaguguucuggaauucugugugaggga

SEQ ID NO: 746 - RNA, 82 nt, Homo sapiens
ggauuguggggggucgcucuaggcaccgcagcacugugcuggggauguugcagcugccugggagugacuucacacaguccuc

SEQ ID NO: 747 - RNA, 143 nt, Homo sapiens
cagaaagcccaguuaaauuugaauuucaaguaaacaaugaauaauuguguauguaagaauaucccauacaauauuugggacauacuuaugcuaaaaauuauuccuugcuuaucugaaauucaaauguaacuaggauuccugua

SEQ ID NO: 748 - RNA, 138 nt, Homo sapiens
ggaugcccagcuaguuugaauuuuagauaaacaacgaauaauuucguagcauaaauaugucccaagcuuaguuugggacauacuuaugcuaaaaaacauuauugguuguuuaucugagauucagaauuaagcauuuua

SEQ ID NO: 749 - RNA, 138 nt, Homo sapiens; identical to SEQ ID NO: 748

SEQ ID NO: 750 - RNA, 138 nt, Homo sapiens; identical to SEQ ID NO: 748

SEQ ID NO: 751 - RNA, 138 nt, Homo sapiens
ggaugcccagcuaguuugaauuuuagauaaacaacgaauaauuucguagcauaaauauuucccaagcuuaguuugggacauacuuaugcuaaaaaacauuauugguuguuuaucugagauucaaaauuaagcauuuua

SEQ ID NO: 752 - RNA, 150 nt, Homo sapiens
aaugcagaagcacagcuaaaauuugaauuucagauaaacaaauuuuucuuagaauaaguaugucuccaugcaacauuugggacauacuuaugcuaaaauauuauuuguguuucaucugaaauucaaauucaacuggacauccuguauuuu

SEQ ID NO: 753 - RNA, 150 nt, Homo sapiens
ugcccggccucccauuaaauugguuuuucagacaaaucacaaauuuguuuagguauaaguauaucccauguaaucuuugggacauacuuaugcuaaaauaauuguuccuuguugauuggaaauuuuaauuuuaauuagguguccuguauu

SEQ ID NO: 754 - RNA, 90 nt, Homo sapiens
aacaaauaauuugguaauauauguauggcccacacaauauuuaggacaacaauauuugggacauacuuaugcuaaaaaaguauuuguuga

SEQ ID NO: 755 - RNA, 72 nt, Homo sapiens
acaacauguuuuuaggacauguaugucuggugcaauaauugggacauacuuaugcuaaaaaaauuaguguuc

SEQ ID NO: 756 - RNA, 128 nt, Homo sapiens
cccauuuaaacuugaauuucauauaaacaccguaauuuucagcauuaguguaucacaugcaguauuugggacauacuuaugcuaaaaaauuaggugguguugaucugaaauuccaguguagaugggca

SEQ ID NO: 757 - RNA, 138 nt, Homo sapiens; identical to SEQ ID NO: 748

SEQ ID NO: 758 - RNA, 86 nt, Homo sapiens
ggcugggcaacauagcgagaccucaacucuacaauuuuuuuuuuuuuaaauuuuagagacggggucuugcucuguugccaggcuuu

SEQ ID NO: 759 - RNA, 91 nt, Homo sapiens
aaacacuugagcccagcgguuugaggcuacagugagaugugauccugccacaucucacuguagccucgaaccccugggcucaagugauuca

SEQ ID NO: 760 - RNA, 86 nt, Homo sapiens
aagauccugcuguuucuaccauuaguuuugaauguuuauuguaaagauacuuuucaacucuaaugggagagacagcaggauucucc

SEQ ID NO: 761 - RNA, 85 nt, Homo sapiens
gugagcagucuccaccaccuccccugcaaacguccaguggugcagagguaauggacguuggcucugguggugauggacaguccga

SEQ ID NO: 762 - RNA, 149 nt, Homo sapiens
caucaagacccagcugagucacugucacugccuaccaaucucgaccggaccucgaccggcucgucuguguugccaaucgacucggcguggcgucggucgugguagauaggcggucaugcauacgaauuuucagcucuuguucuggugac

SEQ ID NO: 763 - RNA, 79 nt, Homo sapiens
acauuaugaagcaaguauuauuaucccuguuuuacaaauaaggaaauaaacucagggaggugaaugugaucaaagauag

SEQ ID NO: 764 - RNA, 71 nt, Homo sapiens
aguaucaugaauuagaaaccuacuuauuacauaguuuacauaagaagcgugaugaugcugcugaugcugua

SEQ ID NO: 765 - RNA, 73 nt, Homo sapiens
acugagguccucaaaacugaggggcauuuucugugguuugaaaggaaagugcacccaguuuuggggaugucaa

SEQ ID NO: 766 - RNA, 96 nt, Homo sapiens
ccugaagaggugcaugaagccugguccugcccucacugggaacccccuucccucuggguaccagacagaauucuaugcacuuuccuggaggcucca

SEQ ID NO: 767 - RNA, 84 nt, Homo sapiens
gcuggcgucggugcuggggagcggcccccgggugggccucugcucuggccccuccuggggcccgcacucucgcucugggcccgc

SEQ ID NO: 768 - RNA, 86 nt, Homo sapiens
ggugggugguuucuccguuugccuguuucgcugaugugcauucaacucauucucagcaaaauaagcaaauggaaaauucguccauc

SEQ ID NO: 769 - RNA, 47 nt, Homo sapiens
cucggcgcggggcgcgggcuccggguuggggcgagccaacgccgggg

SEQ ID NO: 770 - RNA, 61 nt, Homo sapiens
gcccuccgcccgugcaccccggggcaggagaccccgcgggacgcgccgagguaggggggac

SEQ ID NO: 771 - RNA, 57 nt, Homo sapiens
gcccgcguguggagccagguguagaggcggagcacagcuggcucuaauuugaggggc

SEQ ID NO: 772 - RNA, 61 nt, Homo sapiens
acagcuguaauuagucaguuuucuguccuguccacacagaaaaccgucuaguuacaguugu

SEQ ID NO: 773 - RNA, 61 nt, Homo sapiens
gggaacagcagcaacaugggccucgcuuccugccggcgcggcccgggcugcugcuguuccu

SEQ ID NO: 774 - RNA, 50 nt, Homo sapiens
ggcucugcggccugcagguagcgcgaaaguccugcgcgucccagaugccc

SEQ ID NO: 775 - RNA, 53 nt, Homo sapiens
uuugggcugggcuggguugggcaguucuucugcuggacucaccugugaccagc

SEQ ID NO: 776 - RNA, 53 nt, Homo sapiens
agagacuggggugcugggcuccccuagacuaggacuccagugcccuccucucc

SEQ ID NO: 777 - RNA, 66 nt, Homo sapiens
ucagcagcacagccuucagccuaaagcaaugagaagccucugaaaggcugaggcaguagauugaau

SEQ ID NO: 778 - RNA, 80 nt, Homo sapiens
cgggaaugccgcggcggggacggcgauugguccguauguguggugccaccggccgccggcuccgccccggcccccgcccc

SEQ ID NO: 779 - RNA, 80 nt, Homo sapiens
cauccaggacaauggugagugccggugccugcccuggggccgucccugcgcaggggccgggugcucaccgcaucugcccc

SEQ ID NO: 780 - RNA, 80 nt, Homo sapiens
ugucccuucagccaguccugugccugccgccuuugugcuguccuuggagggaggcagaagcaggaugacaaugagggcaa

SEQ ID NO: 781 - RNA, 80 nt, Homo sapiens
ucggcaucugcugaguaccgccaugucuguugggcauccacagucucccaccaggcauuguggucuccgcugacgcuuug

SEQ ID NO: 782 - RNA, 80 nt, Homo sapiens
cucuaggaugugcucauugcaugggcuguguauaguauuauucaauacccagagcaugcagugugaacauaauagagauu

SEQ ID NO: 783 - RNA, 80 nt, Homo sapiens
accucuaccucccggcagaggaggcugcagaggcuggcuuuccaaaacucugcccccuccgcugcugccaaguggcuggu

SEQ ID NO: 784 - RNA, 80 nt, Homo sapiens
cgugugagcccgcccugugcccggcccacuucugcuuccucuuagcgcaggaggggucccgcacugggaggggcccucac

SEQ ID NO: 785 - RNA, 80 nt, Homo sapiens
ugagaggccgcaccuugccuugcugcccgggccgugcacccgugggccccagggcgacgcggcgggggcggcccuagcga

SEQ ID NO: 786 - RNA, 77 nt, Homo sapiens
uauaggcaugugccaccacaccuggcuuaaaugugucauuuaaaaauucaggccaggcacaguggcucaugccugua

SEQ ID NO: 787 - RNA, 77 nt, Homo sapiens; identical to SEQ ID NO: 786

SEQ ID NO: 788 - RNA, 44 nt, Homo sapiens
uauguucaacggccaugguauccugaccgugcaaagguagcaua

SEQ ID NO: 789 - RNA, 52 nt, Homo sapiens
gcagcaaggaaggcagggguccuaagguguguccuccugcccuccuugcugu

SEQ ID NO: 790 - RNA, 55 nt, Homo sapiens
cuguuuugauaacaguaaugucccuuuaguucaaaguuaccagcuaucaaaacaa

SEQ ID NO: 791 - RNA, 91 nt, Homo sapiens
cuugccauguaaauacagauuuaauuaacauuugcaaccugugaagaugcaaaacuuuaaguguuaauuaaaccucuauuuacauagcaag

SEQ ID NO: 792 - RNA, 49 nt, Homo sapiens
cuguaauauaaauuuaauuuauucucuaucauuaaaaaauguauuacag

SEQ ID NO: 793 - RNA, 75 nt, Homo sapiens
cagggguuuggggaaacggccgcugagugaggcgucggcuguguuucucaccgcggucuuuuccucccacucuug

SEQ ID NO: 794 - RNA, 91 nt, Homo sapiens
uuuucaaagcaaugugugacagguacagggacaaaucccguuaauaaguaagaggauuugugcuuggcucugucacaugccacuuugaaaa

SEQ ID NO: 795 - RNA, 80 nt, Homo sapiens
ccuccaugcuccuagucccuuccuugaagcggucggauaaucacaugacgagccucaagcaagggacuucaagcuggugg

SEQ ID NO: 796 - RNA, 100 nt, Homo sapiens
acugucaucccacugcuuccagcuuccaugacuccugauggaggaaucacaugaauucaucagaauucauggaggcuagaagcaguaugaggaucauuua

SEQ ID NO: 797 - RNA, 80 nt, Homo sapiens
gaccuaggcuagggguucuuagcauaggaggucuucccaugcuaagaaguccucccaugccaagaacucccagacuagga

SEQ ID NO: 798 - RNA, 80 nt, Homo sapiens
gcucugauuuacuucuguccggcauggugaacagcaggauuggcuguagcuguucucuuugccaaggacagaucugaucu

SEQ ID NO: 799 - RNA, 89 nt, Homo sapiens
guguucuuccaguccgcccucugucaccuugcagacggcuuucucuccgaaugucugcaagugucagaggcgaggaguggcagcugcau

SEQ ID NO: 800 - RNA, 93 nt, Homo sapiens
gugcuuccugcgggcugagcgcgggcugagcgcugccagucagcgcucacauuaaggcugacagcgcccugccuggcucggccggcgaagcuc

SEQ ID NO: 801 - RNA, 96 nt, Homo sapiens
gugcugcagguguuggagagcaguguguguugccuggggacuguguggacugguaucacccagacagcuugcacugacuccagacccugccgucau

SEQ ID NO: 802 - RNA, 87 nt, Homo sapiens
cagacgugucauccccagauacaauggacaauaugcuauuauaaucguauggcauuguccuugcuguuuggagauaauacugcugac

SEQ ID NO: 803 - RNA, 84 nt, Homo sapiens
auggucccucccaauccagccauuccucagaccagguggcucccgagccaccccaggcuguaggaugggggugagaggugcuag

SEQ ID NO: 804 - RNA, 81 nt, Homo sapiens
ggacaggcaccugaggcucuguuagccuuggcucuggguccugcuccuuagagcagaggcagagaggcucagggucugucu

SEQ ID NO: 805 - RNA, 105 nt, Homo sapiens
gcccccuuuucacgcauuuguguuuuaccaccuccaggagacugcccaaagacucuucaguaucauggaguugguaaagcacagaugcaugaauaauucaacgug

SEQ ID NO: 806 - RNA, 110 nt, Homo sapiens
accuuccugaaagagguuggggcaggcagugacuguucagacguccaaucucuuugggacgccucuucagcgcugucuucccugccucugccuuuaggacgagucucaaa

SEQ ID NO: 807 - RNA, 90 nt, Homo sapiens
ggcgccucugcagcuccggcucccccuggccucucgggaacuacaagucccagggggccuggcggugggcggcgggcggaagaggcgggg

SEQ ID NO: 808 - RNA, 69 nt, Homo sapiens
gguguuagggccaacaucucuuggucuuuccccuguggucccaagauggcuguugcaacuuaacgccau

SEQ ID NO: 809 - RNA, 66 nt, Homo sapiens
ggucuggcuguuguggugugcaaaacuccguacauugcuauuuugccacacugcaacaccuuacag

SEQ ID NO: 810 - RNA, 79 nt, Homo sapiens
cugcccucuucaacaaaaucacugaugcuggagucgccugagucaucacucagcaccaggauauuguuggagaggacag

SEQ ID NO: 811 - RNA, 81 nt, Homo sapiens
gcucgacuccuguuccugcugaacugagccaguguguaaaaugagaacugauaucagcucaguaggcaccggagggcgggu

SEQ ID NO: 812 - RNA, 68 nt, Homo sapiens
ucugaauauggguuuacuaguugguggugaauucaugagucgccaacuauuaggccuuuauguccaga

SEQ ID NO: 813 - RNA, 74 nt, Homo sapiens
cuuuauugagucccuacuauguuccaggcacuggguaucguaggugccuggaacauaguagggacucaauaaag

SEQ ID NO: 814 - RNA, 68 nt, Homo sapiens
uauugagucccuacuauguuccaggcaccuacgauacccagugccuggaacauaguagggacucaaua

SEQ ID NO: 815 - RNA, 78 nt, Homo sapiens
cccuaaagggccagacacuauacgagucauauaagggaaggcauuauaggacucauauagugccagguguuuuguggg

SEQ ID NO: 816 - RNA, 75 nt, Homo sapiens
cacacuacaauaauuuucauaaugcaaucacacauaaucacuaugugacugcauuaugaaaauucuuguagugug

SEQ ID NO: 817 - RNA, 73 nt, Homo sapiens
acacuacaauaauuuucauaaugcaaucacacauaaucacuaugugacugcauuaugaaaauucuuguagugu

SEQ ID NO: 818 - RNA, 75 nt, Homo sapiens; identical to SEQ ID NO: 816

SEQ ID NO: 819 - RNA, 75 nt, Homo sapiens
cauacuacaauaauuuucauaaugcaaucacacacaaucaccgugugacugcauuaugaaaauucuucuagugug

SEQ ID NO: 820 - RNA, 76 nt, Homo sapiens
cacacauacaauaauauucauaaugcaaucacacacaaucaccaugugacugcauuaugaaaauucuucuagugug

SEQ ID NO: 821 - RNA, 75 nt, Homo sapiens; identical to SEQ ID NO: 819

SEQ ID NO: 822 - RNA, 85 nt, Homo sapiens
auuaacucuggcuuuuaacuuugauggcaaagggguagcuaaacaaucuaugucuuugccaucaaaguuaaaagccauaguuaau

SEQ ID NO: 823 - RNA, 85 nt, Homo sapiens
auuaacuauggcuuuuaacuuugauggcaaagacauagauuguuuagcuaccccuuugccaucaaaguuaaaagccagaguuaau

SEQ ID NO: 824 - RNA, 81 nt, Homo sapiens
gucaugugacugccugucugugccugcuguacaggugagcggauguucugcacagcaaguguagacaggcagacacaugac

SEQ ID NO: 825 - RNA, 77 nt, Homo sapiens
aaaugguuauguccuuugccuauucuauuuaagacacccuguaccuuaaauagaguaggcaaaggacagaaacauuu

SEQ ID NO: 826 - RNA, 73 nt, Homo sapiens
accagcucuguugggacaagaggacggucuucuuuuggaaggaagaccaucaucuuguccgaagagagcuggu

SEQ ID NO: 827 - RNA, 75 nt, Homo sapiens
auggauuugauugaaugauucucccauuuccacauggagaguggagcccagagaauuguuuaaucauguauccau

SEQ ID NO: 828 - RNA, 67 nt, Homo sapiens
gcgggcuucgcgggcgaaggcaaagucgauuuccaaaagugacuuuccucacucccgugaagucggc

SEQ ID NO: 829 - RNA, 78 nt, Homo sapiens
gagaauggguagaggaagcuguggagagaacucacggugccugugguucgagauccccgccuuccuccuccuuuccuc

SEQ ID NO: 830 - RNA, 74 nt, Homo sapiens
augauuauaugagggacagaugccagaagcacugguuaugauuugcaucuggcauccgucacacagauaauuau

SEQ ID NO: 831 - RNA, 76 nt, Homo sapiens
ggccaggcccaucagggcuuguggaaugggaaggagaagggacgcuuccccuucugcaggccugcuggguguggcu

SEQ ID NO: 832 - RNA, 66 nt, Homo sapiens
uuccucuggcaaguaaaaaacucucauuuuccuuaaaaaaugagaguuuuuuacuugcaauaggaa

SEQ ID NO: 833 - RNA, 76 nt, Homo sapiens
guacuugggcaguaguguagagauugguuugccuguuaaugaauucaaacuaaucucuacacugcugcccaagagc

SEQ ID NO: 834 - RNA, 75 nt, Homo sapiens
cuugucaugucuuacccagucuccggugcagccuguugucaaggcugcaccggagacuggguaagacaugacaag

SEQ ID NO: 835 - RNA, 75 nt, Homo sapiens
cuugucaugucuuacccagucuccggugcagccuugacaacaggcugcaccggagacuggguaagacaugacaag

SEQ ID NO: 836 - RNA, 63 nt, Homo sapiens
gagucgaggacugguggaagggccuuuccccucagaccaaggcccuggccccagcuucuucuc

SEQ ID NO: 837 - RNA, 75 nt, Homo sapiens
ggugggauggguagagaaggagcucagaggacggugcgccuuguuucccuugagcccucccucucucaucccacc

SEQ ID NO: 838 - RNA, 78 nt, Homo sapiens
cagaaauuguaaagaacucuuaaaacccaauaguaaaaagacaaccuguugaguuuuaagaguucuuuauauauucug

SEQ ID NO: 839 - RNA, 74 nt, Homo sapiens
uguauccaauguguagucuuuuaucccucacauggaguaaaauaugauggauaaaagacuacauauuggguaca

SEQ ID NO: 840 - RNA, 77 nt, Homo sapiens
ucacuuuggugccuaggcugagacugcaguggugcaaucucaguucacugcagccuugaccuccugggcucagguga

SEQ ID NO: 841 - RNA, 68 nt, Homo sapiens
ugcccaggcuggagcgagugcaguggugcagucaguccuagcucacugcagccucgaacuccugggcu

SEQ ID NO: 842 - RNA, 78 nt, Homo sapiens
aauaugaaacugacugaauagguagggucauuuuucugugacugcacauggcccaaccuauucaguuaguuccauauu

SEQ ID NO: 843 - RNA, 75 nt, Homo sapiens
uacaggucuguagccugggagcaaugggguguaugguauagggguagccucgugcuccugggcuacaaaccugua

SEQ ID NO: 844 - RNA, 82 nt, Homo sapiens
cccuccucggcacuucccccaccucacugcccgggugcccacaagacuguggacagugagguagagggagugccgaggaggg

SEQ ID NO: 845 - RNA, 76 nt, Homo sapiens
ggcucagaguaggagcucaacagaugccuguugacugaauaauaaacagguaucgcaggagcuuuuguuaugugcc

SEQ ID NO: 846 - RNA, 90 nt, Homo sapiens
ccucuugagguaccugaauuaccaaaagcuuuauguauucugaaguuauugaaaauaagagcuuuugggaauucagguaguucaggagug

SEQ ID NO: 847 - RNA, 61 nt, Homo sapiens
ucacccggugagggcggguggaggaggaggguccccaccaucagccuucacugggacggga

SEQ ID NO: 848 - RNA, 82 nt, Homo sapiens
uucagaaaggccuuucugaaccuucagaaaggcugcugaaucuucagaaaggccuuucugaaccuucagaaaggcugcugaa

SEQ ID NO: 849 - RNA, 63 nt, Homo sapiens
uagauaacauuguaaagcgcuucuuucgcgguugggcuggagcaacucuuuacaauguuucua

SEQ ID NO: 850 - RNA, 79 nt, Homo sapiens
aacuacacuuuaaggggaccaaagagauauauagauaucagcuaccuauauaccuguucggucucuuuaaaguguaguu

SEQ ID NO: 851 - RNA, 82 nt, Homo sapiens
uauaugaguucaacuccaaacacucaaaacucauuguugaauggaaugagauauuuugaguguuuggaauugaacucguaua

SEQ ID NO: 852 - RNA, 79 nt, Homo sapiens
gcuaagucccuucuuucuauccuaguauaacuugaagaauucaaauagucaugcuaggauagaaagaaugggacuuggc

SEQ ID NO: 853 - RNA, 66 nt, Homo sapiens
guccggguugggcagugaggagggugugacgccgcgaagugcaccucgcccuuguccaacucggac

SEQ ID NO: 854 - RNA, 77 nt, Homo sapiens
gaguuaagauggaaaaaacuggugugugcuuauugauguagccaacaagcauacaucaguuuuuuccaacuuaacuc

SEQ ID NO: 855 - RNA, 83 nt, Homo sapiens
auacauacauguacacacacaugucauccacacacauacauauauauauguuuguauggauauguguguguauguguguguau

SEQ ID NO: 856 - RNA, 80 nt, Homo sapiens
gggaagcaggccaaccucgacgaucuccucagcaccugaacgccaaggcuggggagauccucgagguuggccugcuuucc

SEQ ID NO: 857 - RNA, 86 nt, Homo sapiens
gagggaaagcaggccaaccucgaggaucuccccagccuuggcguucaggugcugaggagaucgucgagguuggccugcuuccccuc

SEQ ID NO: 858 - RNA, 76 nt, Homo sapiens
ggggugauggguggggcaaugggaucaggugccucaaagggcaucccaccugaucccacagcccaccugucacccc

SEQ ID NO: 859 - RNA, 74 nt, Homo sapiens
gugcagaguuauugccucuguucuaacacaagacuaggcuucccuguguuagaauaggggcaauaacucugcac

SEQ ID NO: 860 - RNA, 82 nt, Homo sapiens
gacaaauuuuaaaugucccuguccccuuccccccaauuaaaguagauugggggaaagcgaguagggacauuuaaaauuuguu

SEQ ID NO: 861 - RNA, 84 nt, Homo sapiens
ggccccuccuucucagccccagcucccgcucaccccugccacgucaaaggaggcagaaggggaguugggagcagagaggggacc

SEQ ID NO: 862 - RNA, 82 nt, Homo sapiens
uccgggcaucaccucccacugcagagccuggggagccggacagcucccuucccaggcucugcagugggaacugaugccugga

SEQ ID NO: 863 - RNA, 56 nt, Homo sapiens
ccacugcagagccugggaagggagcuguccggcuccccaggcucugcagugggagg

SEQ ID NO: 864 - RNA, 75 nt, Homo sapiens
gcagaagaaagaucuggaagugggagacacuuuuacuauauauaguggcucccacuuccagaucuuucucucugu

SEQ ID NO: 865 - RNA, 77 nt, Homo sapiens
ugcagaagaaagaucuggaagugggagacacuuucacuauauauaguggcucccacuuccagaucuuucucucugua

SEQ ID NO: 866 - RNA, 77 nt, Homo sapiens
ugcagaagaaagaucuggaagugggagacacuuucacuauauauaguggcucccacuuccugaucuuucucucugua

SEQ ID NO: 867 - RNA, 85 nt, Homo sapiens
gggaagggcuucagccaggcuagugcagucugcuuugugccaacacuggggugaugacugcccuagucuagcugaagcuuuuccc

SEQ ID NO: 868 - RNA, 81 nt, Homo sapiens
auucaggccgguccugcagagaggaagcccuucugcuuacagguauuggaagggcuuccucucugcaggaccggccugaau

SEQ ID NO: 869 - RNA, 81 nt, Homo sapiens
auucaggccgguccugcagagaggaagcccuuccaauaccuguaagcagaagggcuuccucucugcaggaccggccugaau

SEQ ID NO: 870 - RNA, 74 nt, Homo sapiens
ccaaaguccuaggauuacaagugucggccacgggcugggcacaguggcucacgccuguaaucccagcauuuugg

SEQ ID NO: 871 - RNA, 85 nt, Homo sapiens
ggaccugcccugggcuuucuagucucagcucuccuccagcucagcuggucaggagagcugagacuagaaagcccagggcagguuc

SEQ ID NO: 872 - RNA, 81 nt, Homo sapiens
accugcccugggcuuucuagucucagcucuccugaccagcugagcuggaggagagcugagacuagaaagcccagggcaggu

SEQ ID NO: 873 - RNA, 77 nt, Homo sapiens
ccucgagagcugauaagaacagaggcccagauugaaguugaauagugcugggccuuuguuuuuaccaaguucccugg

SEQ ID NO: 874 - RNA, 82 nt, Homo sapiens
cugacuuuuuuagggaguagaaggguggggagcaugaacaauguuucucacucccuaccccuccacuccccaaaaaagucag

SEQ ID NO: 875 - RNA, 73 nt, Homo sapiens
uuccucaucuauaaaaugagggcaguaagaccuuccuuccuugucuuacuacccccauuuuauagaugaggaa

SEQ ID NO: 876 - RNA, 83 nt, Homo sapiens
cuuggaaacugugacuuuaagggaaauggcgcacagcagacccugcaaucaugccguuuugcuugaagucgcaguuucccagg

SEQ ID NO: 877 - RNA, 75 nt, Homo sapiens
ccgguggcaagguggaugcaaugugaccucaacucuugguccucugaggucacauuguauccaccuuaccacugg

SEQ ID NO: 878 - RNA, 92 nt, Homo sapiens
aaauuuuuuugaggccaguaggcauugucugcguuaggauuucuguaucauccuccuaacgcagacaaugccuacuggccuaagaaaaauuu

SEQ ID NO: 879 - RNA, 85 nt, Homo sapiens
ggcuguggaggcaccaguauuucugaaauucuuuuuucugaaauucuucaggaaggauuucagaaauacuggugucccgacagcc

SEQ ID NO: 880 - RNA, 82 nt, Homo sapiens
aagaucaugaguucuacagucagacagccugaguuggaggcucaucuucacuucuugcugugugacccugggccagugacuu

SEQ ID NO: 881 - RNA, 83 nt, Homo sapiens
augugaaaacauaggacugugcuuggcacauagcacaaagucuuaugguacugugugccaagcauaguccuguguuuuuacau

SEQ ID NO: 882 - RNA, 77 nt, Homo sapiens
cugguaacacugggguucugagacagacaguguuagcuccagaagcauugccugucuuagaaccccuauguuaccag

SEQ ID NO: 883 - RNA, 74 nt, Homo sapiens
uauauauagagauguauggaaucuguauauaucuauauauauguguauauauagauuccauaaaucuauauaug

SEQ ID NO: 884 - RNA, 68 nt, Homo sapiens
ucccugcccugccuguuuucuccuuugugauuuuaugagaacaaaggaggaaauaggcaggccaggga

SEQ ID NO: 885 - RNA, 87 nt, Homo sapiens
guuaccugguagugaguuagagaugcagagcccugggcuccucagcaaaccuacuggaucugcauuuuaauucacaugcaugguaau

SEQ ID NO: 886 - RNA, 77 nt, Homo sapiens
ccuggggggcggggagagaacgcagugacgucuggccgcgugcgcaugucgggcgcuuucuccucccccuacccagg

SEQ ID NO: 887 - RNA, 90 nt, Homo sapiens
uggccucuccagucugcagcucccggcagccucgggccacacucccgggauccccagggacuggccugggacuaccggggguggcggccg

SEQ ID NO: 888 - RNA, 82 nt, Homo sapiens
ccacgugccauguguacacacgugccaggcgcugucuugagacauucgcgcagugcacggcacuggggacacguggcacugg

SEQ ID NO: 889 - RNA, 84 nt, Homo sapiens
gaggcugggcggggcgcggccggaucggucgagagcguccuggcugaugacggucucccgugcccacgccccaaacgcagucuc

SEQ ID NO: 890 - RNA, 84 nt, Homo sapiens
caggaucacagacguuuaaauuacacuccuucugcugugccuuacagcaguagaaggggugaaauuuaaacgucugugauccug

SEQ ID NO: 891 - RNA, 84 nt, Homo sapiens; identical to SEQ ID NO: 890

SEQ ID NO: 892 - RNA, 84 nt, Homo sapiens; identical to SEQ ID NO: 890

SEQ ID NO: 893 - RNA, 94 nt, Homo sapiens
cagugcgacgggcggagcuuccagacgcuccgccccacgucgcaugcgccccgggaaagcguggggcggagcuuccggaggccccgcccugcug

SEQ ID NO: 894 - RNA, 88 nt, Homo sapiens
gcgacgggcggagcuuccagacgcuccgccccacgucgcaugcgccccgggaaagcguggggcggagcuuccggaggccccgcccugc

SEQ ID NO: 895 - RNA, 94 nt, Homo sapiens; identical to SEQ ID NO: 893

SEQ ID NO: 896 - RNA, 153 nt, Homo sapiens
gcuccgccccacgucgcaugcgccccgggaacgcguggggcggagcuuccggaggccccgcucugcugccgacccuguggagcggagggugaagccuccggaugccagucccucaucgcuggccuggucgcgcuguggcgaagggggcggagc

SEQ ID NO: 897 - RNA, 153 nt, Homo sapiens
gcuccgccccacgucgcaugcgccccgggaacgcguggggcggagcuuccggaggccccgcccugcugccgacccuguggagcggagggugaagccuccggaugccagucccucaucgcuggcccggucgcgcuguggcgaagggggcggagc

SEQ ID NO: 898 - RNA, 73 nt, Homo sapiens
cggcgaccaucgggcccucggcgccggcccguuaguugcccgggcccgagccggccgggcccgcggguugccg

SEQ ID NO: 899 - RNA, 63 nt, Homo sapiens
gcugcuucuguaguguaguccgugcauccgcccuucgaugcuuggguuggaucauagagcagu

SEQ ID NO: 900 - RNA, 84 nt, Homo sapiens
cucugcccugccucucucggagucgcucggagcagucacguugacggaauccuccggcgccuccucgagggaggagaggcaggg

SEQ ID NO: 901 - RNA, 75 nt, Homo sapiens
aagcaagacugaggggccucagaccgagcuuuuggaaaauagaaaagucucgcucucugccccucagccuaacuu

SEQ ID NO: 902 - RNA, 68 nt, Homo sapiens
gaauggaagaagaaggcggucggucugcgggagccaggccgcagagccauccgccuucuguccauguc

SEQ ID NO: 903 - RNA, 85 nt, Homo sapiens
agccugcgguuccaacaggcgucugucuacguggcuucaaccaaguucaaagucacgcggagagauggcuuuggaaccaggggcu

SEQ ID NO: 904 - RNA, 70 nt, Homo sapiens
gcuggcccugggcagcguguggcugaaggucaccauguucuccuuggccauggggcugcgcggggccagc

SEQ ID NO: 905 - RNA, 85 nt, Homo sapiens
ggcgccuccugcucugcugugccgccagggccuccccuagcgcgccuucuggagaggcuuugugcggauacggggcuggaggccu

SEQ ID NO: 906 - RNA, 73 nt, Homo sapiens
gccucaguugccccaucugugcccuggguaggaauauccuggauccccuugggucugaugggguagccgaugc

SEQ ID NO: 907 - RNA, 80 nt, Homo sapiens
cuggggucaccugucuggccagcuacguccccacggcccuugucaguguggaagguagacggccagagaggugaccccgg

SEQ ID NO: 908 - RNA, 76 nt, Homo sapiens
ggggucaccucucuggccgucuaccuuccacacugacaagggccguggggacguagcuggccagacaggugacccc

SEQ ID NO: 909 - RNA, 77 nt, Homo sapiens
ggaagggauucugggagguuguagcaguggaaaaaguucuuuucuuccucugaucgcccucucagcucuuuccuucu

SEQ ID NO: 910 - RNA, 55 nt, Homo sapiens
uccugcguaggaucugaggaguggacgagucucauuacccagcuccugagcagga

SEQ ID NO: 911 - RNA, 73 nt, Homo sapiens
agguggcagggccagccaccaggagggcugcgugccacccgggcagcucugcugcucacuggcagugucaccu

SEQ ID NO: 912 - RNA, 84 nt, Homo sapiens
ccgcagccgccgcgccgggcccggguuggccgcugacccccgcggggcccccggcggccggggcgggggcgggggcugccccgg

SEQ ID NO: 913 - RNA, 64 nt, Homo sapiens
gggugggggcggggcggcaggggccucccccagugccaggccccauucugcuucucucccagcu

SEQ ID NO: 914 - RNA, 73 nt, Homo sapiens
ggcgaggggaggcgcaggcucggaaaggcgcgcgaggcuccaggcuccuucccgauccaccgcucuccucgcu

SEQ ID NO: 915 - RNA, 80 nt, Homo sapiens
gacugugcucucacuguucacccagcacuagcaguaccagacgguucuguggaguccuggggaauggagagagcacaguc

SEQ ID NO: 916 - RNA, 80 nt, Homo sapiens
gacucugcucucacuguucacccagcacuagcaguaccagaugguucuguggaguccuggggaauggagagagcacaguc

SEQ ID NO: 917 - RNA, 88 nt, Homo sapiens
ggugacuccagggacugccuuaggagaaaguuucuggaaguucugacauuccagaaacuuucuccuaaggcagucccugggagucacu

SEQ ID NO: 918 - RNA, 86 nt, Homo sapiens
gugacucccagggacugccuuaggagaaaguuucuggaaugucagaacuuccagaaacuuucuccuaaggcagucccuggagucac

SEQ ID NO: 919 - RNA, 85 nt, Homo sapiens
gguggucgagggaaucugagaaggcgcacaagguuuguguccaauacaguccacaccuugcgcuacucaggucugcucgugcccu

SEQ ID NO: 920 - RNA, 52 nt, Homo sapiens
gggauaugaagaaaaauaagaggcuaggauugccucuuauuuuuacaugccc

SEQ ID NO: 921 - RNA, 81 nt, Homo sapiens
uauuaauauggaagggagaagagcuuuaaugauuggagucauuuucagagcauuaaagcucuucucccuuccauauuaaug

SEQ ID NO: 922 - RNA, 79 nt, Homo sapiens
auuaauauggaagggagaagagcuuuaaugcucugaaaaugacuccaaucauuaaagcucuucucccuuccauauuaau

SEQ ID NO: 923 - RNA, 78 nt, Homo sapiens
ggcaccauuagguagacugggauuuguuguugagcgcaguaagacaacaacaaaaucacuagucuuccagauggggcc

SEQ ID NO: 924 - RNA, 73 nt, Homo sapiens
caguagcuauuuagugugauaauggcguuugauaguuuagacacaaacaccauugucacacuccacagcucug

SEQ ID NO: 925 - RNA, 100 nt, Homo sapiens
acuuuauacguguaauugugaugaggauggauagcaaggaagccgcucccaccugacccucacggccuccguguuaccuguccucuaggugggacgcucg

SEQ ID NO: 926 - RNA, 63 nt, Homo sapiens
uuguugcuaucuagguuagugaaggcuauuuuaauuuuuuuaaaauuucuuucacuacuuagg

SEQ ID NO: 927 - RNA, 79 nt, Homo sapiens
aagguugcggugcaugugaugaagcaaaucaguaugaaugaauucaugauacuguaaacgcuuucugauguacuacuca

SEQ ID NO: 928 - RNA, 80 nt, Homo sapiens
guaacaguaacuuuuauucucauuuuccuuuucucuaccuuguagagaagcaaagugaugaguaauacuggcuggagccc

SEQ ID NO: 929 - RNA, 73 nt, Homo sapiens
aagagccgcggcguaacggcagccaucuuguuuguuugagugaaucggaaaggaggcgccggcuguggcggcg

SEQ ID NO: 930 - RNA, 83 nt, Homo sapiens
agcaggucuaauaagaauuucuuuuucuucacaauuaugaaagaaaagaaauugugaagaaagaaauucuuacuaguuuugcu

SEQ ID NO: 931 - RNA, 87 nt, Homo sapiens
gggacuggggaugaggaggcaucuugagaaauggaaggaaugggaucuacuuccaguucacuagaggcguccugacaccccuagcuc

SEQ ID NO: 932 - RNA, 87 nt, Homo sapiens
ugguuggguuuggauuguuguacuuuuuuuuuuguucguugcauuuuuaggaacaaaaaaaaaagcccaacccuucacaccacuuca

SEQ ID NO: 933 - RNA, 86 nt, Homo sapiens
gguucugucuugggccacuuggaucugaaggcugccccuuugcucucugggguagccuucagaucuugguguuuugaauucuuacu

SEQ ID NO: 934 - RNA, 87 nt, Homo sapiens
gacucugggacgcucagacgccgcgcggggcggggauuggucugugguccucucucggcuccucgcggcucgcggcggccgacgguu

SEQ ID NO: 935 - RNA, 92 nt, Homo sapiens
ugucacuccgccagcaucaugaagugcacucaugauauguuugccccaucagcgugucacgagggcauuucaugaugcaggcgggguuggca

SEQ ID NO: 936 - RNA, 79 nt, Homo sapiens
aggucauagaaagacauaguugcaagaugggauuagaaaccauaugucucaucagcacccuauguccuuucucugcccu

SEQ ID NO: 937 - RNA, 88 nt, Homo sapiens
uaagcugagugcauugugauuuccaauaauugaggcagugguucuaaaagcugucuacauuaaugaaaagagcaauguggccagcuug

SEQ ID NO: 938 - RNA, 83 nt, Homo sapiens
acggcaucuuugcacucagcaggcaggcuggugcagcccguggugggggaccauccugccugcugugggguaaggacggcugu

SEQ ID NO: 939 - RNA, 79 nt, Homo sapiens
gugaggugggggccagcagggagugggcugggcugggcugggccaagguacaaggccucacccugcaucccgcacccag

SEQ ID NO: 940 - RNA, 85 nt, Homo sapiens
gugagcugcuggggacgcgggucggggucugcagggcggugcggcagccgccaccugacgccgcgccuuugucugugucccacag

SEQ ID NO: 941 - RNA, 83 nt, Homo sapiens
aauagagggugcacaggcacgggagcucaggugaggcagggagcugagcucaccugaccucccaugccugugcacccucuauu

SEQ ID NO: 942 - RNA, 95 nt, Homo sapiens
agugauauaauagagggugcacaggcaugggaggucaggugagcucagcucccugccucaccugagcucccgugccugugcacccucuauuggcu

SEQ ID NO: 943 - RNA, 84 nt, Homo sapiens
uucaguagguuggguucauuucauuuucaugacaacccuauaugggaaaauguugugaaaaugaaaugagcccagcccauugaa

SEQ ID NO: 944 - RNA, 180 nt, Homo sapiens
cgcgacugcggcggcggugguggggggagccgcggggaucgccgagggccggucggccgccccgggugccgcgcggugccgccggcggcggugaggccccgcgcgugugucccggcugcggucggccgcgcucgagggguccccguggcguccccuuccccgccggccgccuuucucgcg

SEQ ID NO: 945 - RNA, 66 nt, Homo sapiens
gcuuggaacaggcaccugugugugcccaaguguuucuagcaaacacagggaccugagugucuaagc

SEQ ID NO: 946 - RNA, 60 nt, Homo sapiens
ucaaggugugucuguagaguccugacugcgugccaggggcucugucuggcacauuucuga

SEQ ID NO: 947 - RNA, 90 nt, Homo sapiens
gauucgaugggccauagcaauccugugauuuaugcauggaggcugcuucuccucagcagcugccauagcccggucgcugguacaugauuc

SEQ ID NO: 948 - RNA, 131 nt, Homo sapiens
cggcuggaggugugaggauccgaacccaggggugggggguggaggcggcuccugcgaucgaaggggacuugagacucaccggccgcacgccaugagggcccugugggugcugggccucugcugcguccugc

SEQ ID NO: 949 - RNA, 110 nt, Homo sapiens
ucccuggggaccccuggcagccccuccugaugauucuucuuccugagcacgcucaugaugagcaaacugagccucuaagaaguugacugaaggggcugcuuccccaagga

SEQ ID NO: 950 - RNA, 56 nt, Homo sapiens
uucaugagcugcaaucucaucacuggaauguuccagcgacuggacaagcugaggaa

SEQ ID NO: 951 - RNA, 83 nt, Homo sapiens
gcuugucgcugcgguguugcuguuggagacucgauuguuggugacagcgaaagaacgauaacaaaaugccggagcgagauagu

SEQ ID NO: 952 - RNA, 69 nt, Homo sapiens
cuuucggccagcgggacggcauccgaggugggcuaggcucgggcccguggcgggugcgggggugggagg

SEQ ID NO: 953 - RNA, 117 nt, Homo sapiens
ugugucccauaauuaaauaaugaaaucugaaaucaccaauaaugggacacuaaugugauuaauguuguugugucccauuauuggugauuucagauuucauauaugauuaaggacaua

SEQ ID NO: 954 - RNA, 56 nt, Homo sapiens
uauuuaagaaaacaccauggagaugaaaugccuuugauuuuuuuuuucuuuuugua

SEQ ID NO: 955 - RNA, 99 nt, Homo sapiens
ucuacaagcagauacaaggaugcccuuguacacaacacacgugcugcuuguauagacaugaguguugucuacgagggcauccuugugucugugugugug

SEQ ID NO: 956 - RNA, 100 nt, Homo sapiens
gaaagaagaacuggacaaaauuaaaaugcucuucugucauuguaauaguucauaugggcacugacaggagagcauuuugacuuugucaagugugucugcu

SEQ ID NO: 957 - RNA, 96 nt, Homo sapiens
caccuucucgcagaggcucuugaccugggacucggacagcugcuugcacucguucagcugcucgauccacugguccagcuccuuggugaacaccuu

SEQ ID NO: 958 - RNA, 95 nt, Homo sapiens
uguguuuuccucaacgcucacaguuacacuucuuacucucaauccauucauauugaaaaugaugaguagugacugaugaagcacaaaucagccaa

SEQ ID NO: 959 - RNA, 97 nt, Homo sapiens
cccgggaccuugguccaggcgcuggucugcguggugcucggguggauaagucugaucugagcaccacacaggccgggcgccgggaccaagggggcuc

SEQ ID NO: 960 - RNA, 99 nt, Homo sapiens
cuguaaacuugaagguagggaacucugucuucacucaugaguaccuuccaacacgagcucucaggaguaaagacagaguucccuaccuucaauguggau

SEQ ID NO: 961 - RNA, 105 nt, Homo sapiens
gcgggcggcggcggcggcagcagcagcaggugcggggcggcggccgcgcuggccgcucgacuccgcagcugcucguucugcuucuccagcuugcgcaccagcucc

SEQ ID NO: 962 - RNA, 111 nt, Homo sapiens
aguaagguccgucaguuguaaugagacccagugcaaguguagaugccgacuccguggcagaguucagcguuucacacugccuggucucugucacucuauugaauuagauug

SEQ ID NO: 963 - RNA, 74 nt, Homo sapiens
ugaggaugaaagacccauugaggagaagguucugcuggcugagaaccuuccucuccaugggucuuucauccuca

SEQ ID NO: 964 - RNA, 75 nt, Homo sapiens
auauaugaaauguagagauugaucaaaauaguuucuaucaaaauaguuuugaucaaucucugcaauuuuauauau

SEQ ID NO: 965 - RNA, 81 nt, Homo sapiens
auauauauauacggaauauauauacggaauauauauauacggaauauauauauacggaauauguauacggaauauauauau

SEQ ID NO: 966 - RNA, 65 nt, Homo sapiens
ucuagacugguauagcugcuuuuggagccucaccugcugagagcucacagcuguccuucucuaga

SEQ ID NO: 967 - RNA, 65 nt, Homo sapiens; identical to SEQ ID NO: 966

SEQ ID NO: 968 - RNA, 88 nt, Homo sapiens
auguuauugcugcugcugucacauuuacaugaaaauaaaauguaaauuauuuuauuucuaucaaauaaggacuagucugcagugauau

SEQ ID NO: 969 - RNA, 82 nt, Homo sapiens
ucuuugugauuaccaugagacucauguaaaacaucuuagacuauuacaagauguuuuaugagucucaugauaaucacaaaga

SEQ ID NO: 970 - RNA, 102 nt, Homo sapiens
auauauauauauggaauguauauacggaauauauauauauauggaauguauauacggaauauauauauauauggaauguauauacggaauauauauauauau

SEQ ID NO: 971 - RNA, 68 nt, Homo sapiens
acaucacuauuguagaaccuaagauuggccguuugagauguccuuucaaguuuuugcauuucugaugu

SEQ ID NO: 972 - RNA, 73 nt, Homo sapiens
ggaugauaaguuauggggcuucuguagagauuucuaugagaacaucucuaaggaacucccccaaacugaauuc

SEQ ID NO: 973 - RNA, 60 nt, Homo sapiens
ggcaguggccagagcccugcagugcugggcaugggcuucucgugggcucuggccacggcc

SEQ ID NO: 974 - RNA, 94 nt, Homo sapiens
gaauccgguccguacaaacucugcuguguugaaugauuggugaguuuguuugcucauugauugaaucacugcagaguuuguacggaccggauuc

SEQ ID NO: 975 - RNA, 68 nt, Homo sapiens
cguggugaggauauggcagggaaggggaguuucccucuauucccuuccccccaguaaucuucaucaug

SEQ ID NO: 976 - RNA, 87 nt, Homo sapiens
aaauuuaaggagggacucacucacaggauugugcaaaugcaaaguuggcuuuugcaugacccugggaguaggugccuccuuaaauuu

SEQ ID NO: 977 - RNA, 87 nt, Homo sapiens; identical to SEQ ID NO: 976

SEQ ID NO: 978 - RNA, 72 nt, Homo sapiens
acuuccaguaguggaugaugcacucugugcagggccaacugugcacacagugcuucauccacuacuggaagu

SEQ ID NO: 979 - RNA, 84 nt, Homo sapiens
uaaguuauauaugucuacuucuaccuguguuaucauaauaaaggugucaugaugauacagguggagguagaaauauauaacuua

SEQ ID NO: 980 - RNA, 82 nt, Homo sapiens
ggguguacacccccugcgacauuggaaguaguaucaucucucccuuggaugcuacgaacaauaucacagaagguguacaccc

SEQ ID NO: 981 - RNA, 74 nt, Homo sapiens
aaucuaaaggaccuguacuagguuuaacauguugagcauuacucauguuagaccuaguacacguccuuuagauu

SEQ ID NO: 982 - RNA, 62 nt, Homo sapiens
guacauuuccuacccuaccugaagacuugagauuauagucuuuggggggaugggcaaaguac

SEQ ID NO: 983 - RNA, 86 nt, Homo sapiens
cucaccucauucauuuaccuucucuuacagaucacuuuucugcacuggacagugaucuguaagagaaaguaaaugaaagaggugag

SEQ ID NO: 984 - RNA, 61 nt, Homo sapiens
cgcgcgugcgcccgagcgcggcccgguggucccucccggacaggcguucgugcgacgugug

SEQ ID NO: 985 - RNA, 93 nt, Homo sapiens
ucuucacuuucaagaguggcaaagucuuuccauauguauguauguaugucuguuacacauauggaaagacuuugccacucuuuaaagugaaga

SEQ ID NO: 986 - RNA, 87 nt, Homo sapiens
ucacuuuaaagaguggcaaagucuuuccauauguguaacagacauacauacauacauauggaaagacuuugccacucuugaaaguga

SEQ ID NO: 987 - RNA, 78 nt, Homo sapiens
ccugggaggugugauaucaugguuccugggaggugugauccugugcuuccugggaggugugauaucgugguuccuggg

SEQ ID NO: 988 - RNA, 148 nt, Homo sapiens
gauccugugcucccuggggggucugauccugugcuuccugggaggugugauaucaugguuccugggaggugugaucccgugcuuccugggaggugugauauugugguuccugggaggugugaucccgugcucccugggaggugugauc

SEQ ID NO: 989 - RNA, 72 nt, Homo sapiens
gggaggugugauaucgugguuccugggaggugugauaucgugguuccugggaggugugauauugugguuccu

SEQ ID NO: 990 - RNA, 74 nt, Homo sapiens
ugggaggugugaucucacacucgcugggaggugugcuaucgucuuccccgggaggugugauccuguucuuccug

SEQ ID NO: 991 - RNA, 80 nt, Homo sapiens
acugggaggugugaucucacacucgcugggaggugugcuaucgucuucccugggaggugugauccuguucuuccugagcg

SEQ ID NO: 992 - RNA, 72 nt, Homo sapiens
gggaggugugauaucaugguuccugggagguaugauaucgugguuccugggaggugugaucccgugcucccu

SEQ ID NO: 993 - RNA, 66 nt, Homo sapiens
aggugugauaucgugcuuccugggacgugugaugcugugcuuccugggaggugugaucccacacuc

SEQ ID NO: 994 - RNA, 75 nt, Homo sapiens
cccaucuccaccuggacccagcguagacaaagagguguuucuacuccauaucuaccuggacccaguguagauggg

SEQ ID NO: 995 - RNA, 75 nt, Homo sapiens; identical to SEQ ID NO: 994

SEQ ID NO: 996 - RNA, 90 nt, Homo sapiens
uugaggcacuggguaguggaugauggagacucgguacccacugcugaggguggggaccaagucugcgucauccucuccucagugccucaa

SEQ ID NO: 997 - RNA, 69 nt, Homo sapiens
ccauuccugcuggucaggaguggauacuggagcaauagauacaguuccacacugacacugcagaagugg

SEQ ID NO: 998 - RNA, 45 nt, Homo sapiens
gguauccguuuggggaugguuucacuauccccagauggauaccaa

SEQ ID NO: 999 - RNA, 65 nt, Homo sapiens
gaaggcagcagugcuccccugugacgugcuccaucaccgggcagggaagacaccgcugccaccuc

SEQ ID NO: 1000 - RNA, 151 nt, Homo sapiens
ggguuggaaagcuguagguguggaggggcauggauacgggggccaugagggugggguccaggcuggaccaggccugcccugagucccccagcaggugcuccaggcuggcucacacccucugccucucucucuuccuuccuggccccaaccc

SEQ ID NO: 1001 - RNA, 126 nt, Homo sapiens
gccugagcaauguagguagacuguuucuaaaaaaauaaaaaguuaaaaaaauuuauguuaacguguaauguguuuacuaauuuuuuuuuuuuuuuuuggagacagagucucccucugucgccaggc

SEQ ID NO: 1002 - RNA, 119 nt, Homo sapiens
gguaugcuguugcgcuguccuuccucuggggagcaggcuccgggggacagggaaaagcacacaaggaacuuguccucuagggccugcagucucaugggagagugacaugcaccaggacc

SEQ ID NO: 1003 - RNA, 111 nt, Homo sapiens
cuuuugcugucaguuuuucuguugcuugucuugguuuuaugccuuuuauaucaaggcacauaaaaggcauaaaaccaagacaagcaacaaaaaaaggauugaucacagaag

SEQ ID NO: 1004 - RNA, 82 nt, Homo sapiens
uuuuuuuguugcuugucuugguuuuaugccuuuuaugugccuugauauaaaaggcauaaaaccaagacaagcaacagaaaaa

SEQ ID NO: 1005 - RNA, 109 nt, Homo sapiens
gggugaggauguguguggauccuggaggaggcagagaagacagugagcuugccaguucugguuuccaacacuuccuuuccugcgcuucucgauucccagaucugcaccc

SEQ ID NO: 1006 - RNA, 105 nt, Homo sapiens
agagaggaaugaacaguuaaauuauaacauguccauauuauggguuaguuguggacacauacuaacgcauaauauggacauguuauaauuuaacuguuccuuucu

SEQ ID NO: 1007 - RNA, 102 nt, Homo sapiens
uuguuuauaauaaacugaaauauuugggacugaucuugaugucugccaaaaccuuggcagacaucaagaucagucccaaauauuucaguuuauuauagacag

SEQ ID NO: 1008 - RNA, 100 nt, Homo sapiens
ugucuauaauaaacugaaauauuugggacugaucuugaugucugccaagguuuuggcagacaucaagaucagucccaaauauuucaguuuauuauaaaca

SEQ ID NO: 1009 - RNA, 99 nt, Homo sapiens
uggacuucagauuuaacuucucauuuucugguuccuucuaaugaguaugcuuaacuugguagaaggaaccagaaaaugagaaguugaguaggaacucua

SEQ ID NO: 1010 - RNA, 95 nt, Homo sapiens
gaguuccuacucaacuucucauuuucugguuccuucuaccaaguuaagcauacucauuagaaggaaccagaaaaugagaaguuaaaucugaaguc

SEQ ID NO: 1011 - RNA, 97 nt, Homo sapiens
caaguuggcacuguagaauauugaggaaaagauggucuuauugcaaagauuuucaauaagaccauccuuuccucaauauucuguggugucaucuuug

SEQ ID NO: 1012 - RNA, 94 nt, Homo sapiens
aucccagagaagaaggaagaagaggaagaaauggcugguucucaggugaaugugucuggguucaggggaugugucuccucuuuucuucugggau

SEQ ID NO: 1013 - RNA, 93 nt, Homo sapiens
ggcgcuuuugugcgcgcccgggucuguuggugcucagaguguggucaggcggcucggacugagcaggugggugcggggcucggaggaggcggc

SEQ ID NO: 1014 - RNA, 93 nt, Homo sapiens
aggcgguuaagccaugggacagggccgcagauggagacugcucaaggucaaaggggucuccagcugggacccugcaccugguucguagccccu

SEQ ID NO: 1015 - RNA, 89 nt, Homo sapiens
ccugagcaccauuuacugaguccuuuguucucuacuaguuuguaguaguucguagcagagaacaaaggacucaguaaauggugcucagg

SEQ ID NO: 1016 - RNA, 86 nt, Homo sapiens
acugagugagggagucagagaguuaagagaauuaguacaggugagauuguacugauuaucuuaacucucugacccccucacucagu

SEQ ID NO: 1017 - RNA, 85 nt, Homo sapiens
ccuagcccaguacaaggcauaugguacucaagagacuuagaaaucccuaagucucugaguaccauaugccuuguacugggcuagg

SEQ ID NO: 1018 - RNA, 84 nt, Homo sapiens
ggaagagucaagucaaggccagaggucccacagcagggcuggaaagcacaccugugggacuucuggccuugacuugacucuuuc

SEQ ID NO: 1019 - RNA, 83 nt, Homo sapiens
gguagagugagcucuaauccaauauuacuagcuucuuuauaagaagaggaaacuaguaauguuggauuagggcucacucuacu

SEQ ID NO: 1020 - RNA, 81 nt, Homo sapiens
uaaaugaaaaaguaguagucaaauaugcagaucuaugucauauauacagauauguauaugugacugcuacuuuuuuguuua

SEQ ID NO: 1021 - RNA, 77 nt, Homo sapiens
gugggaauagcaagagaacugaaaguggagccugucacaucuccagacuccaguuuuaguucucuugcuauuuccac

SEQ ID NO: 1022 - RNA, 73 nt, Homo sapiens
aaaauggagcuggccaaaaagcaggcagagacuuuaaaagcgucucugccugcuuuuuggccagcuccguuuu

SEQ ID NO: 1023 - RNA, 63 nt, Homo sapiens
ggagcuggccaaaaagcaggcagagacgcuuuuaaagucucugccugcuuuuuggccagcucc

SEQ ID NO: 1024 - RNA, 71 nt, Homo sapiens
ugccaaugccuaucacauaucugccuguccuaugacaaacauggcagguagauauuugauaggcauuggca

SEQ ID NO: 1025 - RNA, 58 nt, Homo sapiens
gcugaagcucuaagguuccgccugcgggcaggaagcggaggaaccuuggagcuucggc

SEQ ID NO: 1026 - RNA, 55 nt, Homo sapiens
aguggcucacaccaguaaucccagcacuuugggaggcugaugugaguagaccacu

SEQ ID NO: 1027 - RNA, 107 nt, Homo sapiens
cacagcccuuccuguccccaguuuucagguguggaaacugaggcaggaggcagugaaguaacuugcucagguugcacagcugggaaguggagcagggauuugaaucc

SEQ ID NO: 1028 - RNA, 104 nt, Homo sapiens
ggauguguuccugucccagaaggagcugaugguuguaucuaugaagguaagcauuuuuguagauacgagcaccagccacccuaagcaaaggcagagaaugcuua

SEQ ID NO: 1029 - RNA, 110 nt, Homo sapiens
augauucagagcaucuguccagugucugcuguagaucccucaaauccguguuuggacgcuucugguaagggguguauggcagaugcacccgacagaugcacuuggcagca

SEQ ID NO: 1030 - RNA, 106 nt, Homo sapiens
agaagaaugcccaaccagcccucaguugcuacaguucccuguuguuucagcucgacaacaacaggcggcuguagcaauggggggcuggaugggcaucucaaugugc

SEQ ID NO: 1031 - RNA, 103 nt, Homo sapiens
aggaauuuuuaacccgaucacuagauuaucuacaagggaauuuuuuuuuaauuuaaaaaauucccuuguagauaacccgguggucagguuggauggcuccaug

SEQ ID NO: 1032 - RNA, 106 nt, Homo sapiens
cuggcuuccaaaggccucuguguguuccuguaugugggcgugcacguaccugucacauguguacgcgcagaccacaggauguccacacuggcuuccaaacacaucu

SEQ ID NO: 1033 - RNA, 102 nt, Homo sapiens
gcuuaucgaggaaaagaucgagguggguuggggcgggcucuggggauuuggucucacagcccggaucccagcccacuuaccuugguuacucuccuuccuucu

SEQ ID NO: 1034 - RNA, 103 nt, Homo sapiens
gagucagaauucucaucaggcugugaugcucaguuguguguagauugaaagcccuaauuuuacacacaacugaggaucauagccugaugguuccuuuuuguuu

SEQ ID NO: 1035 - RNA, 109 nt, Homo sapiens
ucuucaguaugacaccucaaagaagcaauacuguuaccugaaauaggcugcgaagauaacaguauuucagauaacaguauuacaucuuugaagugucauauucacugac

SEQ ID NO: 1036 - RNA, 100 nt, Homo sapiens
cacacagacggcagcugcggccuagcccccaggcuucacuuggcguggacaacuugcuaaguaaaguggggggugggccacggcuggcuccuaccuggac

SEQ ID NO: 1037 - RNA, 108 nt, Homo sapiens
uccacccagcaggcgcagguccugugcagcaggccaaccgagaagcgccugcgucucccauuuucgggcuggccugcugcuccggaccugugccugaucuuaaugcug

SEQ ID NO: 1038 - RNA, 98 nt, Homo sapiens
gauguugaugcacgugacggggagggcauaggagaggguugauauaaaaugcaauuacagccucuuaugcuuuccaaagugggggaugauucaaugau

SEQ ID NO: 1039 - RNA, 91 nt, Homo sapiens
ggcgccccggcuccccgcgcccccgaucggggccgccgcuaguaguggcggcggcggaggcgggggcagcggcggcggcggcggaggcgcc

SEQ ID NO: 1040 - RNA, 87 nt, Homo sapiens
gcccauuugccuuggcuugggguggcaguccugugggaaugagagaugccaaacuggaccugccagccccguuccagggcacagcau

SEQ ID NO: 1041 - RNA, 107 nt, Homo sapiens
gcccaggguagcucucuguauugcuuguuacauuuuaggauugcuugccccuugcuccaauggugcaggcagaagaaaugcaaacaaaguacagcauuagccuuagc

SEQ ID NO: 1042 - RNA, 96 nt, Homo sapiens
guucagggaaaaggucauuguaagguuaaugcacccauauuuuaauaucaaacuaugacaaauuugacuacagccuuuccguaccccugccaaaac

SEQ ID NO: 1043 - RNA, 70 nt, Homo sapiens
cauguaggugagugauugcuauuucaaaagacuagagguaggaaaugaggcuaaugcacuacuucacaug

SEQ ID NO: 1044 - RNA, 139 nt, Homo sapiens
ugagggauauagagagcaggaagauuaaugucauauuggaguuggacugcagggcuuccuuuacacaauaaauauuguaugaagugcugauguaaccuuuacugcagcaugacaugggauuuggcuguuuuuauggcuc

SEQ ID NO: 1045 - RNA, 70 nt, Homo sapiens
uugugcuucaucguaauuaaccuuaagugguucggguaaaucacuuuaauuuguuauguguuggcagaau

SEQ ID NO: 1046 - RNA, 101 nt, Homo sapiens
ucaguggaaagcaugcauccaggguguggagccaaaauuagaagggccaaaauucuaccuggcccacuaccacagcaaccuugggcaucguuuucuuuuga

SEQ ID NO: 1047 - RNA, 61 nt, Homo sapiens
cacguccuccagcuuuuuuccuuaguggccaauuccugagaaaagggccaacgugcuucca

SEQ ID NO: 1048 - RNA, 63 nt, Homo sapiens
uggggggcuggcagcucaucaguccaggccaucuggccacugagucagcaccagcgcccaauc

SEQ ID NO: 1049 - RNA, 68 nt, Homo sapiens
ccagccaucgcccuugaggggcccuaggacuuacuugugcagggcauguccaggggguccaggucugc

SEQ ID NO: 1050 - RNA, 76 nt, Homo sapiens
cuugggaggagggugggguggcuccucugcagugaguaggucugccuggagcuacuccaccaucucccccagcccc

SEQ ID NO: 1051 - RNA, 72 nt, Homo sapiens
gagcauccuucaguguucagagauggagucaguauuggucuggccauuuuuagggcaaagaggcagcaucau

SEQ ID NO: 1052 - RNA, 64 nt, Homo sapiens
uguuccauuuaucugaccugaugaaggucuccuggcauugauuaggucugaugauccauuucug

SEQ ID NO: 1053 - RNA, 86 nt, Homo sapiens
ggcuuagaaacagucccuagguaggauuuggggaggagcuaagaagccccuacagggcccagagguggggacugagccuuaguugg

SEQ ID NO: 1054 - RNA, 91 nt, Homo sapiens
acgccccccgccccgccaccgccuuggaggcugaccucuuacuuucggucggucuucuucccugggcuugguuugggggcgggggaguguc

SEQ ID NO: 1055 - RNA, 101 nt, Homo sapiens
gaugggccccuuguguccugaauugggugggggcucugaguggggaaagugggggccuaggggaggucacaguugggucuaggggucaggagggcccagga

SEQ ID NO: 1056 - RNA, 67 nt, Homo sapiens
aacaaggugacuuggggcauggagucccacuuccuggagcccacaccccagcuugucacacaccaac

SEQ ID NO: 1057 - RNA, 58 nt, Homo sapiens
gguggaaguggguuccucccaguuccugagacaggaaacagggacccaggagaccagc

SEQ ID NO: 1058 - RNA, 54 nt, Homo sapiens
gaaagcugcaggugcugauguuggggggacauucagacuaccugcagcagagcc

SEQ ID NO: 1059 - RNA, 83 nt, Homo sapiens
auagugcucuucaggguuuuacuugggagauuggaguggccaguguuccuaaacaauucuaagugccuuggcccacaacauac

SEQ ID NO: 1060 - RNA, 66 nt, Homo sapiens
aaagcuggauacucagucauggucauuguaacaugauagugacagguacuggguaagacugcauag

SEQ ID NO: 1061 - RNA, 99 nt, Homo sapiens
ugcaguggguuggagcuucagccuacaccuguaaagaauuggucagccuggggacuggugaucucugcagcugugggcucagcucugggcugggccugg

SEQ ID NO: 1062 - RNA, 55 nt, Homo sapiens
ccacugcuggccggggccccuacucaaggcuaggaggccuuggccaaggacaguc

SEQ ID NO: 1063 - RNA, 82 nt, Homo sapiens
cucagcaggcuccagcucgguggcacugggggaaggcuccagaccccagccucugucaucccugcauggagcccacaucucc

SEQ ID NO: 1064 - RNA, 64 nt, Homo sapiens
augcacaucagguucuagagguuuugcccuagcggcuccuccucucaggaugugaugucaccug

SEQ ID NO: 1065 - RNA, 84 nt, Homo sapiens
acagcgcccugcaggcacagacagcccuggcuucugccucuuucuuuguggaagccacucugucaggccugggauggaggggca

SEQ ID NO: 1066 - RNA, 70 nt, Homo sapiens
acaaauagcuucagggagucaggggagggcagaaauagauggccuuccccugcugggaagaaaguggguc

SEQ ID NO: 1067 - RNA, 67 nt, Homo sapiens
aaaucucucuccauaucuuuccugcagcccccaggugggggggaagaaaagguggggaauuagauuc

SEQ ID NO: 1068 - RNA, 64 nt, Homo sapiens
uuuucugcacaaauuaaucaguuaaugcauagaaagcauucaacuagugauuguguuauaagag

SEQ ID NO: 1069 - RNA, 84 nt, Homo sapiens
uccccuguguguguucucugauggacaguaagccuugacuuauggcuaaaugcuucuucacaauggucacaugcauagggcuuu

SEQ ID NO: 1070 - RNA, 91 nt, Homo sapiens
ggggcauuuaggguaacugagcugcugccggggccuggcgcuccucuaccuugucaggugacccagcagucccucccccugcauggugccc

SEQ ID NO: 1071 - RNA, 87 nt, Homo sapiens
acauuuuuguccaauuaccacuucuuuuugccaccugagcacagucagcagucagcauaaaaaagugauaaugggaaguuaaugucu

SEQ ID NO: 1072 - RNA, 70 nt, Homo sapiens
cacagucugacucagugacucaugugcuggcaguggccacguaaauagagcuacugugucugaaagcaau

SEQ ID NO: 1073 - RNA, 84 nt, Homo sapiens
cugggucgaggcaguucugagcacaguacacugggcugcccccacugcccagugcccugcucagcucaaguccuugugccccuc

SEQ ID NO: 1074 - RNA, 69 nt, Homo sapiens
aucuaacaccaggagaaucccauagaacauugacaucaacacuaggggguuugcccuuguggggaagaa

SEQ ID NO: 1075 - RNA, 58 nt, Homo sapiens
ugcucuguggagcugaggagcagauucucucucucuccucccggcuucaccuccugag

SEQ ID NO: 1076 - RNA, 76 nt, Homo sapiens
aaucaggguggaguguaguucugagcagagccuuaaaggaugagguauguucaagacugaaugacaccuuugugau

SEQ ID NO: 1077 - RNA, 62 nt, Homo sapiens
gcugggggucccccgacaguguggagcuggggccgggucccggggagggggguucugggcag

SEQ ID NO: 1078 - RNA, 67 nt, Homo sapiens
ggugaaguuccaggggaagauuuuaguaugccacauuucuaaaauuugcauccaggaacaucauccu

SEQ ID NO: 1079 - RNA, 80 nt, Homo sapiens
acucugauccuggggcucagcgaguuugcaagggguguuucuguccauggucaggcuugccagccuugguccuugggccc

SEQ ID NO: 1080 - RNA, 80 nt, Homo sapiens; identical to SEQ ID NO: 1079

SEQ ID NO: 1081 - RNA, 81 nt, Homo sapiens
guucugugaggggcucacaucaccccaucaaaguggggacucauggggagaggggguaguuaggagcuuugauagaggcgg

SEQ ID NO: 1082 - RNA, 85 nt, Homo sapiens
auuagcuggggcggcgaguccgacucaucaauauuuuaaggaaugacccggccuuggggugcggaauugcugcgcgggcgggggc

SEQ ID NO: 1083 - RNA, 93 nt, Homo sapiens
uacuuauggcaccccacuccugguaccauagucauaaguuaggagauguuagagcugugaguaccaugacuuaagugugguggcuuaaacaug

SEQ ID NO: 1084 - RNA, 78 nt, Homo sapiens
uaguucuuuuucucccuugagggcacuuuucaguuccugagaucaauguggucccuacuggggagaccauaggagccc

SEQ ID NO: 1085 - RNA, 67 nt, Homo sapiens
auggagguggagagucaucagcagcacugagcaggcaguguugucugcugaguuuccacgucauuug

SEQ ID NO: 1086 - RNA, 70 nt, Homo sapiens
ccuugggagggcauugugcagggcuaucaggcaguuuccugggcccugucugcagagccuaaacagauca

SEQ ID NO: 1087 - RNA, 95 nt, Homo sapiens
gccaccaagaaggugaagggagggucagucccaaucugaaucccaccaaaauaggugguagaggguugcccuccuuucuucccucaccucugacc

SEQ ID NO: 1088 - RNA, 65 nt, Homo sapiens
cgccgggggcuucagcaggaacagcuggguggaggcagagcuguucugcuguggcugcagcccug

SEQ ID NO: 1089 - RNA, 67 nt, Homo sapiens
gagacaccagaaggccaccugcuuaggaggccagaggugccccugggccggccuuggugaggggccc

SEQ ID NO: 1090 - RNA, 78 nt, Homo sapiens
agagacaccuguuccuugggaagcuggugacauugcuaauucauuucacaccagccugacaggaacagccugacugaa

SEQ ID NO: 1091 - RNA, 76 nt, Homo sapiens
ccgaugccucgggagucuacagcagggccaugucugugagggcccaagggugcaugugucucccagguuucggugc

SEQ ID NO: 1092 - RNA, 85 nt, Homo sapiens
cuuuguggaacagugcaauguuuuccuugccuguggcaagaccacuucgguucaaggcuaagaaacuagacuguuccuacagaga

SEQ ID NO: 1093 - RNA, 88 nt, Homo sapiens
uugggcuuugaugugggcucaggcucagagggcugaagugguuguggggaggggcuucuggggacuguguccaugucucugucguuuu

SEQ ID NO: 1094 - RNA, 76 nt, Homo sapiens
agcacgcacgugccuuccugucugugccugccuucgaagugcacggcagggccaggacgggucgcugugggugggg

SEQ ID NO: 1095 - RNA, 73 nt, Homo sapiens
ggggagguaccugggacaggaggaggaggcagccuugccucagaaaccaaacugucaaaaguguagguuccac

SEQ ID NO: 1096 - RNA, 72 nt, Homo sapiens
ggguucugaccaaucauguuacaguguuuucuccuuuagagagagcuggugacaugagaggcagaaaaagga

SEQ ID NO: 1097 - RNA, 96 nt, Homo sapiens
ugaguuuagaagagggccagcuaaaucagcagagacaugaggugaucaaaaaccuuuuuucaaagcagugggagcuggacuacuucugaaccaaua

SEQ ID NO: 1098 - RNA, 66 nt, Homo sapiens
accagccaccucccacuacuucacuugugaacauugcauucguggaggguggcaggugcagcucug

SEQ ID NO: 1099 - RNA, 60 nt, Homo sapiens
ucaggagggaccaguguggcucagcgagguggcugaguuuacuuaagguauuggaaugag

SEQ ID NO: 1100 - RNA, 66 nt, Homo sapiens
agaaaauagcuucugagcugaggacagcuugcucugcuuuucuuuagcuuaggagcuaaccauggu

SEQ ID NO: 1101 - RNA, 62 nt, Homo sapiens
agagaaguggccggcauguccagggcauccccauugcucugugacugcugccauccuucucc

SEQ ID NO: 1102 - RNA, 102 nt, Homo sapiens
cugccuuagaccuagacaccuccaguucuggguucuuagaggccuaauccucuacaaacucaguuuucagacugugagggaaauucucugucuuauugcuuu

SEQ ID NO: 1103 - RNA, 91 nt, Homo sapiens
aagcugcuuaguguccuuagagucuccagaggcaucccuaacccagaaucuuuugacuguccucuggagagaaaggcaguaggucuguacc

SEQ ID NO: 1104 - RNA, 84 nt, Homo sapiens
ucagaagaaaaaacaggagauaaaguuugugauaauguuugucuauauaguuaugaauguuuuuuccuguuuccuucagggcca

SEQ ID NO: 1105 - RNA, 81 nt, Homo sapiens
uauggguucagagggaacuccauuggacagaaauuuccuuuugaggaaaucuuucccuggaguuucuucuuaccuuuuucc

SEQ ID NO: 1106 - RNA, 83 nt, Homo sapiens
ucuggggguucuggagucuaggauuccaggaucuggguuuugaggucuuggguuguagggucugcgguuugaagccccucuug

SEQ ID NO: 1107 - RNA, 57 nt, Homo sapiens
uggcgucuggggccugaggcugcagaacauugcagcauucaugucccacccccacca

SEQ ID NO: 1108 - RNA, 100 nt, Homo sapiens
ucagagaggggaaagagagcugagugugaccuggagcagcucaggagggcuuccugggugagguggcagguuacagguucgaucuuuggcccucagauuc

SEQ ID NO: 1109 - RNA, 76 nt, Homo sapiens
gaaagguugggggcacagagagcaaggagccuuccccagaggagucaggccuuguuccuguccccauuccucagag

SEQ ID NO: 1110 - RNA, 101 nt, Homo sapiens
gaucaggcccagcccccuggccccaaacccugcagccccagcuggaggaugaggagaugcugggcuugggugggggaaucagggguguaaaggggccugcu

SEQ ID NO: 1111 - RNA, 92 nt, Homo sapiens
ggccauuccucucugggaaaugggacagguaguggccacagugagaaagcuggccuguccuucugccccagggcccagagucugugacugga

SEQ ID NO: 1112 - RNA, 73 nt, Homo sapiens
ugggcuuugcccgcuuucugagcuggacccucucucuaccucuggugcagaacuacagcggaaggaaucucug

SEQ ID NO: 1113 - RNA, 73 nt, Homo sapiens; identical to SEQ ID NO: 1112

SEQ ID NO: 1114 - RNA, 71 nt, Homo sapiens
aguggcccagggugaggcuagcugguguggucacccacucuccagcccagccccaaucccaccacaaccac

SEQ ID NO: 1115 - RNA, 65 nt, Homo sapiens
aaaaggcgagacauugccagggaguuuauuuuguagcucucuugauaaaauguuuuagcaaacac

SEQ ID NO: 1116 - RNA, 81 nt, Homo sapiens
gcuucuuaauuaugucauaaacccacuguggacaagggccuugucuuagacagucacuguggguacaugcuaggugcucaa

SEQ ID NO: 1117 - RNA, 85 nt, Homo sapiens
uuggcuugagucccugagcaaagccacugggaaugcucccugaggacguuauaugagugcucagcucauggggcuaugaugguca

SEQ ID NO: 1118 - RNA, 65 nt, Homo sapiens
gacaugugggguuugcuguagacauuucagauaacucgggauucuguagcuuccuggcaacuuug

SEQ ID NO: 1119 - RNA, 80 nt, Homo sapiens
cuggucuccgcagagccucugccccucccgagacacccgcuaccugguguuagcgguggaccgcccugcgggggccuggc

SEQ ID NO: 1120 - RNA, 73 nt, Homo sapiens
accgcgaguuccgcgccuggccgugucgccccacgagggggacugugggcucagcgcguggggcccggagcau

SEQ ID NO: 1121 - RNA, 69 nt, Homo sapiens
cggggcccaggcgggcauguggggugucuggagacgccaggcagccccacagccucagaccucgggcac

SEQ ID NO: 1122 - RNA, 72 nt, Homo sapiens
cggccccuuuguuaagggucucagcuccagggaacuuuaaaacccugagacccuaaccuuaaaggugcugca

SEQ ID NO: 1123 - RNA, 90 nt, Homo sapiens
ggggaagauguugcacuugucucagugagagaugcuucuagauccaggaggcagaccucaaggauggagagaaggcagauccuuugagau

SEQ ID NO: 1124 - RNA, 59 nt, Homo sapiens
gcugcucugcuguuccucugucucccagacucuggguggauggagcaggucgggggcca

SEQ ID NO: 1125 - RNA, 85 nt, Homo sapiens
ggccuggguaggcuugcaugggggacugggaagagaccaugaacagguuaguccagggaguucucaucaagccuuuacucaguag

SEQ ID NO: 1126 - RNA, 56 nt, Homo sapiens
aacaguugaguccugagaaccauugagaaccaguuuucccaggauuaacuguuccg

SEQ ID NO: 1127 - RNA, 71 nt, Homo sapiens
uagagaggaagguguaccaggguuuuggaguuuuuuuuuccuccugagacccuaguuccacauucuggagc

SEQ ID NO: 1128 - RNA, 105 nt, Homo sapiens
aauugucagcaggcaauuaucugaggaugcaggagaggaagggggcuucuuuuugacgccuacuucaucagcugcuccucagaucagagccuugcaggucaggcc

SEQ ID NO: 1129 - RNA, 73 nt, Homo sapiens
gaaaacaaccaggugggcuucccggagggcggaacacccagccccagcauccagggcucaccuaccacguuug

SEQ ID NO: 1130 - RNA, 62 nt, Homo sapiens
ugguuuuugcucugagugaccguggugguugugggagucacugcaggacucagcaggaauuc

SEQ ID NO: 1131 - RNA, 77 nt, Homo sapiens
ugguggugugugccuguagucuuagcuacucgggaggcugagggaggagacugcagugaguggaggucacgccacug

SEQ ID NO: 1132 - RNA, 68 nt, Homo sapiens
cucaggcucaguggugcaugcuuauagucccagccacucuggaggcugaaggaagauggcuugagccu

SEQ ID NO: 1133 - RNA, 77 nt, Homo sapiens
cucuugguaugaacaucuguguguucaugucucucugugcacaggggacgagagucacugaugucuguagcugagac

SEQ ID NO: 1134 - RNA, 69 nt, Homo sapiens
cugggucuccuuucugcugagaguugaacacuuguugggacaaccugucuguggaaaggagcuaccuac

SEQ ID NO: 1135 - RNA, 83 nt, Homo sapiens
aguucuucugcagacaaaagcaucaggaaguacccaccauguaccagugggcccuucuugaugcucuugauugcagaggagcc

SEQ ID NO: 1136 - RNA, 80 nt, Homo sapiens
aucauguacugcaguugccuuuuuguucccaugcuguuuaagccuagcauaggcaccaaaaagcaacaacaguaugugaa

SEQ ID NO: 1137 - RNA, 86 nt, Homo sapiens
cuuacaucacacacagaguuaacucaaaauggacuaauuuuuccacuaguuaguccauuucaaguuaacucugugugugauguagu

SEQ ID NO: 1138 - RNA, 84 nt, Homo sapiens
gugcuuuacaugaauggucccauugaaucccaacagcuuugcgaaguguuguugggauucagcaggaccauucguguaaaguaa

SEQ ID NO: 1139 - RNA, 63 nt, Homo sapiens
aguuggaagauggacguacuuugucugacuacaauauucaaaaggagucuacucuucaucuug

SEQ ID NO: 1140 - RNA, 68 nt, Homo sapiens
gaagccucuuggggcuuauuuagacaaugguuucaucauuucgucugaauagagucugaagagucuuu

SEQ ID NO: 1141 - RNA, 73 nt, Homo sapiens
uuggcaggugccauguugccugcuccuuacuguacacguggcuggcaaggagacgggaacauggagccgccau

SEQ ID NO: 1142 - RNA, 73 nt, Homo sapiens
agggagaaaagcugggcugagaggcgacuggugucuaauuuguuugucucuccaacucagacugccuggccca

SEQ ID NO: 1143 - RNA, 49 nt, Homo sapiens
gugaggcuggagugagcggagaucguaccacugcacuccaaccugguga

SEQ ID NO: 1144 - RNA, 94 nt, Homo sapiens
ugguuugcgacucugaaaacuagaagguuuaugacugggcauuucucacccaaugcccaauauugaacuuucuaguugucagagucauuaaccc

SEQ ID NO: 1145 - RNA, 84 nt, Homo sapiens
gcaucuugcagagccguuccaaugcgacaccucuagagugucauccccuagaaugucaccuuggaaagacucugcaagaugccu

SEQ ID NO: 1146 - RNA, 81 nt, Homo sapiens
cauccuccuuacgucccaccccccacuccuguuucuggugaaauauucaaacaggagugggggugggacauaaggaggaua

SEQ ID NO: 1147 - RNA, 102 nt, Homo sapiens
uguguucccuauccuccuuaugucccacccccacuccuguuugaauauuucaccagaaacaggaguggggggugggacguaaggaggaugggggaaagaaca

SEQ ID NO: 1148 - RNA, 53 nt, Homo sapiens
ucacuuuaggagaaguaaaguagaacuuugguuuucaacuuuuccuacagugu

SEQ ID NO: 1149 - RNA, 80 nt, Homo sapiens
aggcagcaaauggccagagcucacacagagggaugagugcacuucaccugcagugugacucagcaggccaacagaugcua

SEQ ID NO: 1150 - RNA, 74 nt, Homo sapiens
gcaaauggccagagcucacacagagggaugagugcacuucaccugcagugugacucagcaggccaacagaugcu

SEQ ID NO: 1151 - RNA, 85 nt, Homo sapiens
gccucacuuuuccacuuaugccugcccugccccucgaaucugcuccacgauuugggcaggacaggcagaaguggauaagugagga

SEQ ID NO: 1152 - RNA, 91 nt, Homo sapiens
guguccucacuuguccacuucugccugcccugcccaaaugguggagcagauucgaggggcagggcaggaagaaguggacaagugaggccau

SEQ ID NO: 1153 - RNA, 91 nt, Homo sapiens; identical to SEQ ID NO: 1152

SEQ ID NO: 1154 - RNA, 60 nt, Homo sapiens
acuuugugcauuggguccacaaggaggggaugacccuugugggcucaggguacaaagguu

SEQ ID NO: 1155 - RNA, 93 nt, Homo sapiens
uaaguguaaacuuaaggacugucuuuucuaagccugugccuugccuuuccuuuggcacaggcuuagaaaagacagucuuuaaguuuacacuuc

SEQ ID NO: 1156 - RNA, 80 nt, Homo sapiens
ccagugacugauaccuuggaggcauuuuaucuaagauacacacaaagcaaaugccucuaagguaucaguuuaccaggcca

SEQ ID NO: 1157 - RNA, 98 nt, Homo sapiens
cucucaccaagcaagugcaguggggcuugcuggcuugcaccgugacucccucucaccaagcaagugucguggggcuugcuggcuugcacugugaagau

SEQ ID NO: 1158 - RNA, 100 nt, Homo sapiens
cagagucuccuucguguacagggaggagacuguacgugagagauagucagauccgcauguuagagcagagucuccuucguguacagggaggagauuguac

SEQ ID NO: 1159 - RNA, 67 nt, Homo sapiens
gcgcccucccucucuccccggugugcaaaugugugugugcgguguuaugccggacaagagggaggug

SEQ ID NO: 1160 - RNA, 53 nt, Homo sapiens
gguggggguuggaggcguggguuuuagaaccuaucccuuucuagcccugagca

SEQ ID NO: 1161 - RNA, 74 nt, Homo sapiens
gugacgacuggccccgccucuuccucucggucccauauugaacucgaguuggaagaggcgaguccggucucaaa

SEQ ID NO: 1162 - RNA, 74 nt, Homo sapiens; identical to SEQ ID NO: 1161

SEQ ID NO: 1163 - RNA, 70 nt, Homo sapiens
uuccugcagauuguuucuuuugccgugcaaguuuaaguuuuugcacggcaaaagaaacaauccagagggu

SEQ ID NO: 1164 - RNA, 67 nt, Homo sapiens
cugguccauuucccugccauucccuuggcuucaauuuacucccagggcuggcagugacaugggucaa

SEQ ID NO: 1165 - RNA, 91 nt, Homo sapiens
guucuagagcaugguuucucaucauuugcacuacugauacuuggggucagauaauuguuuguggugggggcuguuguuugcauuguaggau

SEQ ID NO: 1166 - RNA, 86 nt, Homo sapiens
aggagugaccaaaagacaagagugcgagccuucuauuaugcccagacagggccaccagagggcuccuuggucuagggguaaugcca

SEQ ID NO: 1167 - RNA, 66 nt, Homo sapiens
agcagcccucggcggcccggggggcgggcggcggugcccgucccggggcugcgcgaggcacaggcg

SEQ ID NO: 1168 - RNA, 65 nt, Homo sapiens
ugucuggggauuuggagaaguggugagcgcaggucuuuggcaccaucuccccuggucccuuggcu

SEQ ID NO: 1169 - RNA, 66 nt, Homo sapiens
ucuguaccucagcuuugcucccaaccaaccacuuccacauguuuugcugguagagcugaggacagc

SEQ ID NO: 1170 - RNA, 71 nt, Homo sapiens
uggaucacuugaggccaagagugcaaggcuguagugugcacagccuugaauucuuggccuuaagugauccc

SEQ ID NO: 1171 - RNA, 89 nt, Homo sapiens
uggagagcuuggucuguagcgguuuccuucggggcagguggggacugcuccuuugggaggaaggaggaggcccaggccgcgucuucagg

SEQ ID NO: 1172 - RNA, 55 nt, Homo sapiens
ccggauccgagucacggcaccaaauuucaugcguguccgugugaagagaccacca

SEQ ID NO: 1173 - RNA, 58 nt, Homo sapiens
agaaggguguguguguuuuuccugagaauaagagaaggaaggacagccaaauucuuca

SEQ ID NO: 1174 - RNA, 43 nt, Homo sapiens
augaaccugguggcuuccuuuucugggaggaaguuaggguuca

SEQ ID NO: 1175 - RNA, 68 nt, Homo sapiens
ggaguacuccagucaauaccgugugaguuagaaaagcucaauucacaagguauugacuggcguauuca

SEQ ID NO: 1176 - RNA, 75 nt, Homo sapiens
gagcgcacagagguagguguggaagaaagugaaacacuauuuuagguuuuaguuacacucugcuguggugugcug

SEQ ID NO: 1177 - RNA, 66 nt, Homo sapiens
acccaggaggcggaggagguggagguugcagugagccaagaucguggcacugacuccagccugggg

SEQ ID NO: 1178 - RNA, 86 nt, Homo sapiens
guuuuuugcccauagugguugugaauuuaccuucuccucuuugcagugauaaaggagguaaauucacaaccacugugggcagaaac

SEQ ID NO: 1179 - RNA, 74 nt, Homo sapiens
gaguaggcuuagguuauguacguagucuaggccauacguguuggagauugagacuaguagggcuaggccuacug

SEQ ID NO: 1180 - RNA, 58 nt, Homo sapiens
cuucccagcugcccuaagucaggaguggcuuuccugacacggaggguggcuugggaaa

SEQ ID NO: 1181 - RNA, 67 nt, Homo sapiens
aauagauuauuggucaccaccuccaguuucugaauuugugagacugggguggggccugagaauuugc

SEQ ID NO: 1182 - RNA, 92 nt, Homo sapiens
ggaaccuuaguaagguuuggauagaugcaauaaaguauguccacagcugaaaggacauacuuuauugcauguauccaaaccuuacuaauuca

SEQ ID NO: 1183 - RNA, 70 nt, Homo sapiens
cauguguccccuggcacgcuauuugagguuuacuauggaaccucaaguagucugaccaggggacacauga

SEQ ID NO: 1184 - RNA, 54 nt, Homo sapiens
acgcgggugcgggccggcgggguagaagccacccggcccggcccggcccggcga

SEQ ID NO: 1185 - RNA, 63 nt, Homo sapiens
ugguggcggcgguaguuaugggcuucucuuucucaccagcagccccugggccgccgccucccu

SEQ ID NO: 1186 - RNA, 64 nt, Homo sapiens
agucuucuccuggggcuuugguggcuaugguugacugggccacucagagcagaaggaugagaug

SEQ ID NO: 1187 - RNA, 79 nt, Homo sapiens
ccgacgcggagagcggcucuagguggguuuggcggcggcgaggacaccgccgcucccucuagggucgcucggagcguga

SEQ ID NO: 1188 - RNA, 72 nt, Homo sapiens
cgagccucuuucggcuuuccaguuugucucgguccuuuggaacguggcaaacguggaagccgagagggcucu

SEQ ID NO: 1189 - RNA, 83 nt, Homo sapiens
ccaaauuuaaaacuuaaaccucuacuaaguuuccaugaaaagaacccaugggaacuuaguagagguuuaaguuuuaaauuuga

SEQ ID NO: 1190 - RNA, 80 nt, Homo sapiens
uggcagacccuugcucucucacucucccuaauggggcugaagacagcucaggggcagggugggggguguuguuuuuguuu

SEQ ID NO: 1191 - RNA, 67 nt, Homo sapiens
uggugggggugggggguguuguuuuuguuuuugagacagagucuugcuccgucgcccaggccggagu

SEQ ID NO: 1192 - RNA, 91 nt, Homo sapiens
aaggaacaggggacacuuguaauggagaacacuaagcuauggacugcuauggacugcuagugcucuccguuacaaguauccccuguuaccu

SEQ ID NO: 1193 - RNA, 78 nt, Homo sapiens
uugccuaccuuguuagucucaugaucagacacaaauauggcucuuuguggcuggucaugaggcuaacaagguaggcac

SEQ ID NO: 1194 - RNA, 61 nt, Homo sapiens
aucucaaugagugugugguucuaaaugacucauagucaagggaccaagcauucauuaugaa

SEQ ID NO: 1195 - RNA, 70 nt, Homo sapiens
aaaagccugucccuaagucccucccagccuuccagaguuggugccaggaaggauuuagggacaggcuuug

SEQ ID NO: 1196 - RNA, 81 nt, Homo sapiens
uccuccucccaucaaucacaaauguccuuaauggcauuuaaggauugcuauuaaggacauuugugauucacgggaggaggu

SEQ ID NO: 1197 - RNA, 81 nt, Homo sapiens
accuccucccgugaaucacaaauguccuuaauagcaauccuuaaaugccauuaaggacauuugugauugaugggaggagga

SEQ ID NO: 1198 - RNA, 86 nt, Homo sapiens
ggccgaggcugagcugaggagccuccaaaccuguagacagggucaugcaguacuaggggcgagccucauccccugcagcccuggcc

SEQ ID NO: 1199 - RNA, 71 nt, Homo sapiens
gaaaccaaguccgagcguggcuggcgcgggaaaguucgggaacgcgcgcggccgugcucggagcagcgcca

SEQ ID NO: 1200 - RNA, 71 nt, Homo sapiens
gcagaggugaguugaccuccacagggccacccagggaguaaguagccaaguggaaguuacuuuaccucugu

SEQ ID NO: 1201 - RNA, 60 nt, Homo sapiens
ggagugggcuggugguuuuuuaagaggaagggagaccuaagcuagcacaugagcacgcuc

SEQ ID NO: 1202 - RNA, 70 nt, Homo sapiens
agugagcaacccagugggcuauggaaauguguggaagauggcauuucuauuucucaguggggcucuuacc

SEQ ID NO: 1203 - RNA, 62 nt, Homo sapiens
aaaaaacaacauacuuagugcauacccauauaauauuagggguggucuguuguuguuuuucu

SEQ ID NO: 1204 - RNA, 83 nt, Homo sapiens
ggguuuccucugccuuuuuuuccaaugaaaauaacgaaaccuguuauuucccauugagggggaaaaaggcgggagaagcccca

SEQ ID NO: 1205 - RNA, 57 nt, Homo sapiens
agaggcaccgccugcccagugacaugcguuuaacggccgcgguacccuaacugugca

SEQ ID NO: 1206 - RNA, 63 nt, Homo sapiens
gcaugcugggcgaggcuggcaucuagcacaggcgguagaugcuugcucuugccauugcaauga

SEQ ID NO: 1207 - RNA, 73 nt, Homo sapiens
acuguccuucagccagagcuggcugaagggcagaagggaacuguccuucagccagagcuggcugaagggcaga

SEQ ID NO: 1208 - RNA, 62 nt, Homo sapiens
gguagggggcgggcuccggcgcugggaccccacuaggguggcgccuuggccccgccccgccc

SEQ ID NO: 1209 - RNA, 62 nt, Homo sapiens
ggggguggggcuagugaugcaggacgcuggggacuggagaaguccugccugacccuguccca

SEQ ID NO: 1210 - RNA, 84 nt, Homo sapiens
auaguuucugcaaugcucaaaucucuggccaaagaccagaacuuaauggucucugguaagagauuugggcauauuagaaacuaa

SEQ ID NO: 1211 - RNA, 68 nt, Homo sapiens
acauuuggucacaccaguccacauuaacguggaccagacaauauuaauguggacuggugugaccaaaa

SEQ ID NO: 1212 - RNA, 80 nt, Homo sapiens
cugcagcgugcuucuccaggccccgcgcgcggacagacacacggacaagucccgccaggggcugggcgcgcgccagccgg

SEQ ID NO: 1213 - RNA, 73 nt, Homo sapiens
ccagagaugggaaggccuuccggugauuaucacagccaugccuuuaccuccagaaggccuuuccaucucuguc

SEQ ID NO: 1214 - RNA, 84 nt, Homo sapiens
aguuuuaguuacccuggucaucugcagucugaaaauacaaaauggaaaauuccagacuguggcugaccagagguaacugaaacc

SEQ ID NO: 1215 - RNA, 66 nt, Homo sapiens
aagaaauguaaacaggcuuuuugcucaguggaguuauuuugagcaaaaagcuuauuuacauuucug

SEQ ID NO: 1216 - RNA, 61 nt, Homo sapiens
acaucagcucauauaauccucgaagcugccuuuagaaaugaggaaacugaagcugagaggg

SEQ ID NO: 1217 - RNA, 89 nt, Homo sapiens
accuccgggacggcugggcgccggcggccgggagauccgcgcuuccugaaucccggccggcccgcccggcgcccguccgcccgcggguc

SEQ ID NO: 1218 - RNA, 66 nt, Homo sapiens
agggcugggcuggcagggcaagugcugcagaucuuugucuaagcagccccugccuuggaucuccca

SEQ ID NO: 1219 - RNA, 69 nt, Homo sapiens
aagacugagaggagggaacuggugaguuguacauagaaaugcuuucuaacuccuugucucagucuguuu

SEQ ID NO: 1220 - RNA, 76 nt, Homo sapiens
caggagagaaaguacugcccagaagcuaaaguguagaucaaacgcauaauggcugagguaguaguuucuugaacuu

SEQ ID NO: 1221 - RNA, 64 nt, Homo sapiens
uaugugaccucggaugaaucacugaaauaugucugagcuucuguuucaucagaugucacauuuu

SEQ ID NO: 1222 - RNA, 81 nt, Homo sapiens
agccuuuagcaaguuguaaucuuuuugcugauggagggucuugccuccauggggauggcugaugaugauggugcugaaggc

SEQ ID NO: 1223 - RNA, 83 nt, Homo sapiens
acaauguagauauuuaagcaggaaauagaauuuacauauaaauuucuauuuguuucuauuuccugcuuaaauaucuacauugc

SEQ ID NO: 1224 - RNA, 92 nt, Homo sapiens
cuaagauaauguccuccagguucaucucuguugucauuuguggcauggaccauuugugacaauagagaugaacauggaggauauuaucuuaa

SEQ ID NO: 1225 - RNA, 73 nt, Homo sapiens
ggaggcugggcugggacggacacccggccuccacuuucuguggcagguaccuccuccaugucggcccgccuug

SEQ ID NO: 1226 - RNA, 77 nt, Homo sapiens
uggccucugccaucagaccaucuggguucaaguuuggcuccaucuuuaugaaauggguggucugaggcaaguggucu

SEQ ID NO: 1227 - RNA, 52 nt, Homo sapiens
ucugggcugagccgagcuggguuaagccgagcuggguugggcugggcugggu

SEQ ID NO: 1228 - RNA, 70 nt, Homo sapiens
aggacccagcggggcugggcgcgcggagcagcgcugggugcagcgccugcgccggcagcugcaagggccg

SEQ ID NO: 1229 - RNA, 94 nt, Homo sapiens
cuuuaauacuaucucaaacuaaaggauauagaagguuuucccuuucucuugcccugaaaccuucuguauccuuuauuuugagauaguauuagaa

SEQ ID NO: 1230 - RNA, 94 nt, Homo sapiens; identical to SEQ ID NO: 1229

SEQ ID NO: 1231 - RNA, 94 nt, Homo sapiens; identical to SEQ ID NO: 1229

SEQ ID NO: 1232 - RNA, 68 nt, Homo sapiens
guguaugugagggaguaggauguaugguuguuagauagacaacuacaaucuuuucucacaacagacag

SEQ ID NO: 1233 - RNA, 87 nt, Homo sapiens
aaaaaaaagggaaagaagaacuguugcauuugcccugcacucaguuugcacaggguaaaugcaauaguucuucuuucccuuuuuuua

SEQ ID NO: 1234 - RNA, 77 nt, Homo sapiens
cucagcccgggcaauauagugagaccucgucucuacaaaaaauugagacagggccucacuguaucgcccaggcugga

SEQ ID NO: 1235 - RNA, 86 nt, Homo sapiens
auucuagguggggagacugacggcuggaggcccauaagcugucuaaaacuucggcccccagauuucuggucuccccacuucagaac

SEQ ID NO: 1236 - RNA, 57 nt, Homo sapiens
guugagacaggcaggauuggggaaacaucuuuuaccucgucucuugccuguuuuaga

SEQ ID NO: 1237 - RNA, 81 nt, Homo sapiens
gcgggagguguaacaggacuggacucccggcagccccagggcaggggcguggggagcugguccuagcucagcgcucccgga

SEQ ID NO: 1238 - RNA, 86 nt, Homo sapiens
agggagaagggucggggcagggagggcagggcaggcucugggguggggggucugugagucagccacggcucugcccacgucucccc

SEQ ID NO: 1239 - RNA, 79 nt, Homo sapiens
agguaaauaugaugaaacucacagcugaggagcuuagcaaguagcuaaggccagagcuuguguuugggugguguggcug

SEQ ID NO: 1240 - RNA, 83 nt, Homo sapiens
ugggggaaaagugcugggauugauuagugaugucugcuggggaaccggggcucagggaugauaacugugcugagaagcccccu

SEQ ID NO: 1241 - RNA, 58 nt, Homo sapiens
aaccucagcagugcgcagggcugcacugucuccgucugcggccugcaguaagcgggua

SEQ ID NO: 1242 - RNA, 70 nt, Homo sapiens
gugugccaccugcguguuuucuguccaaaucagaaaaggauuuggacagaaaacacgcaggaagaaggaa

SEQ ID NO: 1243 - RNA, 54 nt, Homo sapiens
ccugcguguuuucuguccaaauccuuuucugauuuggacagaaaacacgcaggu

SEQ ID NO: 1244 - RNA, 60 nt, Homo sapiens
ucggcuaaggaaguccugugcucaguuuuguagcaucaaaacuaggauuucucuuguuac

SEQ ID NO: 1245 - RNA, 87 nt, Homo sapiens
gcgggcguugccugggggccucgcagggggagauccagcccaggcugguuccgcugacucugccuguaggccgguggcgucuucugg

SEQ ID NO: 1246 - RNA, 69 nt, Homo sapiens
gcgggggaccgagagggccucggcugugugaggacuagaggcggccgaggcccgggccgguucccccga

SEQ ID NO: 1247 - RNA, 69 nt, Homo sapiens
gaacgauagcagcaugaaccugucucacugcagaauuauuuugagacaggcuuaugcugcuauccuuca

SEQ ID NO: 1248 - RNA, 115 nt, Homo sapiens
uagcuggguggauguguucuuuugaaggauagcagcauaagccugucucaaaauaauucugcagugagacagguucaugcugcuaucguuccaaagaggaaggguaaucacuguc

SEQ ID NO: 1249 - RNA, 75 nt, Homo sapiens
gucagaggggggaugugcaugcugguuggggugggcugccuguggaccaaucagcgugcacuuccccacccugaa

SEQ ID NO: 1250 - RNA, 87 nt, Homo sapiens
ugcggugacaucagggcccagucccugcugucaugccccaggugacgugcugggcugacagcagggcuggccgcuaacgucacuguc

SEQ ID NO: 1251 - RNA, 70 nt, Homo sapiens
ccagaaguggucugcaaagagaugacugugaauccaagauccacaucagcucugugcugccuacaucuga

SEQ ID NO: 1252 - RNA, 90 nt, Homo sapiens
uauucuacugagaguacagaucuuuauauauaugaucauuauauguaugaugagaucauuauauguaugaucuggacacccaguagaauc

SEQ ID NO: 1253 - RNA, 78 nt, Homo sapiens
augacaggccaucagcaguccaaugaagacaugaagacccaaugucuucauuggacugcugauggcccgucacuggga

SEQ ID NO: 1254 - RNA, 56 nt, Homo sapiens
cgaccgcacccgcccgaagcugggucaaggagcccagcaggacgggagcgcggcgc

SEQ ID NO: 1255 - RNA, 47 nt, Homo sapiens
gccuaggaguccuuggucaguggggacauggagaaggcuucugagga

SEQ ID NO: 1256 - RNA, 51 nt, Homo sapiens
acagaccccggggagcccggcggugaagcuccugguauccugggugucuga

SEQ ID NO: 1257 - RNA, 71 nt, Homo sapiens
ugagaauguggaaggagguugccggacgcugcuggcugccuuccagcguccacuucccuuucucucucucc

SEQ ID NO: 1258 - RNA, 60 nt, Homo sapiens
ugugaaugacccccuuccagagccaaaaucaccagggauggaggaggggucuuggguacu

SEQ ID NO: 1259 - RNA, 59 nt, Homo sapiens
aacugggucccagucuucacaguugguuucugacacguggaccuggcugggacgaugug

SEQ ID NO: 1260 - RNA, 88 nt, Homo sapiens
augugguagauauaugcacgauauauauacugcccugcuuuuauacauacauacauacauaccuauaucgugcauauaucuaccacau

SEQ ID NO: 1261 - RNA, 88 nt, Homo sapiens
augugguagauauaugcacgauauagguauguauguauguauguauaaaagcagggcaguauauauaucgugcauauaucuaccacau

SEQ ID NO: 1262 - RNA, 70 nt, Homo sapiens
ugagccgagcugagcuuagcugggcugagcuaaccagggcugggcugagcugggcugagcugagcugagc

SEQ ID NO: 1263 - RNA, 78 nt, Homo sapiens
gagcuuggaugagcugggcugaacugggcuggguugagcugggcugggcugaguugagccaggcugaucugggcugag

SEQ ID NO: 1264 - RNA, 60 nt, Homo sapiens
ugagcugggcucugcugugcugugcugagcagggcugagcugaacugggcugagcugggc

SEQ ID NO: 1265 - RNA, 55 nt, Homo sapiens
aagcugcauggaccaggacuuggcaccuuuggccuuaguccugccuguagguuua

SEQ ID NO: 1266 - RNA, 61 nt, Homo sapiens
gagggcagcguggguguggcggaggcaggcgugaccguuugccgcccucucgcugcucuag

SEQ ID NO: 1267 - RNA, 79 nt, Homo sapiens
uggcaagucuccgcauaugccuggcuagcuccuccacaaaugcguguggaggagcuagccaggcauaugcagagcguca

SEQ ID NO: 1268 - RNA, 54 nt, Homo sapiens
ggacaagggcggcgcgaccggcccggggcucuugggcggccgcguuuccccucc

SEQ ID NO: 1269 - RNA, 79 nt, Homo sapiens
ccgggacuuuguggguucugaccccacuuggaucacgccgacaacacuggucuugaagucagaacccgcaaaguccugg

SEQ ID NO: 1270 - RNA, 80 nt, Homo sapiens
uagauucagaacucguguucaaagccuuuagcccagcaaugggagagugcuaaaggcuucaagcacgaguucugaaucua

SEQ ID NO: 1271 - RNA, 84 nt, Homo sapiens
cccuuacuuggaucugcaauuaguauuuuaaucauagauuguauuuaguuaguuuuuaauacuaacugcagauucaagugaggg

SEQ ID NO: 1272 - RNA, 68 nt, Homo sapiens
gacucggcugcgguggacaaguccggcuccagaaccuggacaccgcucagccggccgcggcagggguc

SEQ ID NO: 1273 - RNA, 69 nt, Homo sapiens
uugcuaaguaggcugagauugaugucagguuauccccaagcauaaccucacucucaccuugcuuugcag

SEQ ID NO: 1274 - RNA, 90 nt, Homo sapiens
cugugggcugggccagggagcagcuggugggugggaaguaagaucugaccuggacuccaucccacccacccccuguuuccuggcccacag

SEQ ID NO: 1275 - RNA, 66 nt, Homo sapiens
ggggggcagggggcagagggcaucagaggacagccgccuggugcccaugccauacuuuugccucag

SEQ ID NO: 1276 - RNA, 82 nt, Homo sapiens
cacaacugcauggcaucguccccugguggcuguggccuagggcaagccacaaagccacucagugaugaugccagcaguugug

SEQ ID NO: 1277 - RNA, 78 nt, Homo sapiens
gugugcccuagcauuuauaaucauguguucauucacaugaucauaaguggacacaugaccauaaaugcuaaagcacac

SEQ ID NO: 1278 - RNA, 84 nt, Homo sapiens
gcggcggugcucugccucuuucuccauccacccugguccagguccacagcaguggagagagaaaagagacagaaggauggccgu

SEQ ID NO: 1279 - RNA, 77 nt, Homo sapiens
ugauagggaaaccaggcaagaaauauugucuccucaaguugcgacgagacaguaguucuugccugguuucucuauca

SEQ ID NO: 1280 - RNA, 63 nt, Homo sapiens
acugggaagaggagcugagggacauugcggagagggucucacauugucccucucccuucccag

SEQ ID NO: 1281 - RNA, 80 nt, Homo sapiens
ccaggagggugaagauggugcugugcugaggaaaggggaugcagagcccugcccagcaccaccaccuccuaugcuccugg

SEQ ID NO: 1282 - RNA, 72 nt, Homo sapiens
ugugggacugcaaaugggagcucagcaccugccugccacccacgcagaccagccccugcucuguucccacag

SEQ ID NO: 1283 - RNA, 64 nt, Homo sapiens
ucugggcgaggggugggcucucagaggggcuggcaguacugcucugaggccugccucuccccag

SEQ ID NO: 1284 - RNA, 76 nt, Homo sapiens
uucuguagagauuaucaggccucuuucuaccuuccaaggcucagaagguagaaugaggccugacauaucugcagga

SEQ ID NO: 1285 - RNA, 76 nt, Homo sapiens; identical to SEQ ID NO: 1284

SEQ ID NO: 1286 - RNA, 73 nt, Homo sapiens
cggcgacggcggggugggugaggucgggccccaagacucgggguuugccgggcgccucaguucaccgcggccg

SEQ ID NO: 1287 - RNA, 78 nt, Homo sapiens
uauuggacgaggggacugguuaauagaacuaacuaaccagaacuauuuuguucuguuaacccauccccucaucuaaua

SEQ ID NO: 1288 - RNA, 83 nt, Homo sapiens
uuguccaauucucugagcaaggcuuaacaccaaaggguuaaggguuugcucuggaguuaaggguugcuuggagaauuggagaa

SEQ ID NO: 1289 - RNA, 76 nt, Homo sapiens
cuggcugguugugggaucuggaggcaucugggguuggaaugugaccccagucuccuuuucccucaucaucugccag

SEQ ID NO: 1290 - RNA, 74 nt, Homo sapiens
ccaagggcacaccggggauggcagagggucgugggaaaguguugacccucgucagguccccggggagccccugg

SEQ ID NO: 1291 - RNA, 75 nt, Homo sapiens
aggcuggcgugggcugagggcaggaggccuguggccggucccaggccuccugcuuccugggcucaggcucgguuu

SEQ ID NO: 1292 - RNA, 53 nt, Homo sapiens
aauguggaaguggucugaggcauauagaguauaugccaagaacacuaccauau

SEQ ID NO: 1293 - RNA, 65 nt, Homo sapiens
gcugcccuucacucagagcaucuacacccacuaccggugaguguggauccuggaggaaucguggc

SEQ ID NO: 1294 - RNA, 81 nt, Homo sapiens
gaaacugcugaagcugccaugucuaagaagaaaacuuuggagaaaaauuuucuucuuagacauggcaacgucaacaguuuc

SEQ ID NO: 1295 - RNA, 73 nt, Homo sapiens
cuguugacguugccaugucuaagaagaaaauuuuucuccaaaguuuucuucuuagacauggcagcuucagcag

SEQ ID NO: 1296 - RNA, 74 nt, Homo sapiens
acuccuucugcagcucugguggaaaauggagaagacuuuuccuuuccuccaucucccccagggccugguggagu

SEQ ID NO: 1297 - RNA, 75 nt, Homo sapiens
uuuacucugaacuagcucuguggauccugacagacagccugauagacaggauccacagagcuaguccagaguaaa

SEQ ID NO: 1298 - RNA, 67 nt, Homo sapiens
ucuauuuagccaauuguccaucuuuagcuauucugaaugccuaaagauagacaauuggcuaaauaga

SEQ ID NO: 1299 - RNA, 81 nt, Homo sapiens
cacaauuucuauuuagccaauugucuaucuuuaggcauucagaauagcuaaagauggacaauuggcuaaauagacacugug

SEQ ID NO: 1300 - RNA, 76 nt, Homo sapiens
cugugguggagcugagcuccauggacgugcaguggcaucugucauugcugccuuccuggagcucaggcccuugcag

SEQ ID NO: 1301 - RNA, 71 nt, Homo sapiens
guugggggcuggggugcccacuccgcaaguuaucacugagcgacuuccggucugugagccccguccuccgc

SEQ ID NO: 1302 - RNA, 79 nt, Homo sapiens
cucgaggugcugggggacgcgugagcgcgagccgcuuccucacggcucggccgcggcgcguagcccccgccacaucggg

SEQ ID NO: 1303 - RNA, 79 nt, Homo sapiens
aucacuuaaauacaugucagauuguaugccuacaaaaucccuccagacuggcauacaaucugacauguauuuaagagau

SEQ ID NO: 1304 - RNA, 81 nt, Homo sapiens
ugucuaaauugcaugucagauuguaauucccaggcccuuccuccaauacugggaauuacaauuugacaugcaauuuagaca

SEQ ID NO: 1305 - RNA, 66 nt, Homo sapiens
ugacuggggagcagaaggagaacccaagaaaagcugacuuggaggucccuccuucuguccccacag

SEQ ID NO: 1306 - RNA, 70 nt, Homo sapiens
agggaaaaaaaaaaggauuugucuuguagccaggauauuguuuuaaagaaaauccuuuuuguuuuuccag

SEQ ID NO: 1307 - RNA, 62 nt, Homo sapiens
gccucccuucacuuccuggccauccaggcaucugugucuguguccgggaaguggaggagggc

SEQ ID NO: 1308 - RNA, 75 nt, Homo sapiens
cucuaggaagcgaccaugauguaacuucacagacucuccaaaagucugaaguuacaucauggucgcuuccuagag

SEQ ID NO: 1309 - RNA, 73 nt, Homo sapiens
uauuuuaagaccgaagacugugcgcuaaucucuuagcacugaagauuagugcauagucuuuggucucaaaaua

SEQ ID NO: 1310 - RNA, 81 nt, Homo sapiens
ggcugcuucucgccucuguccagcuguguggccuuggacaagccucuugguuacacagcuggacagaggcacgaaacagcc

SEQ ID NO: 1311 - RNA, 59 nt, Homo sapiens
guccaggcaggagccggacuggaccucagggaagaggcugacccggccccucuugcggc

SEQ ID NO: 1312 - RNA, 87 nt, Homo sapiens
cccaggcgcccgcucccgacccacgccgcgccgccgggucccuccuccccggagaggcugggcucgggacgcgcggcucagcucggg

SEQ ID NO: 1313 - RNA, 77 nt, Homo sapiens
caugagaaauccugcuggucaaccauagcccuggucagacucuccggggcugugauugaccagcaggacuucucaug

SEQ ID NO: 1314 - RNA, 72 nt, Homo sapiens
ugaaugaaagagccaguggugagacagugaguugauuacuucucacuguuucaccacuggcucuuugguuca

SEQ ID NO: 1315 - RNA, 80 nt, Homo sapiens
gcaaagcagcaauuguucuuuggucuuucagccaugaccugaccuucugucugugagaccaaagaacuacuuugcuuggc

SEQ ID NO: 1316 - RNA, 74 nt, Homo sapiens
ggaaaaaacaagguauuguucagacuuaugauuuuuggggucaaagauucugagcaauaaccuauuaaaaaacc

SEQ ID NO: 1317 - RNA, 75 nt, Homo sapiens
gucuuuuuucugugauagagauucuuugcuuuguuagaaacaaaaagcaaagaaucucuaucacagaaaaaagau

SEQ ID NO: 1318 - RNA, 77 nt, Homo sapiens
uaucuuuuuucugugauagagauucuuugcuuuuuguuucuaacaaagcaaagaaucucuaucacagaaaaaagacg

SEQ ID NO: 1319 - RNA, 66 nt, Homo sapiens
uauaagaacucuugcagucuuagauguuauaaaaauauauaucugaauuguaagaguuguuagcac

SEQ ID NO: 1320 - RNA, 72 nt, Homo sapiens
ggcaacgggaaugcaggcuguaucugcagggcauugugcuaacaggugcaggcugcagaccugucacaggcc

SEQ ID NO: 1321 - RNA, 80 nt, Homo sapiens
ugccccuggucugaguuccuggagccuggucugucacuggggaaguccagagcuccaaggcucagugcccaggggacgca

SEQ ID NO: 1322 - RNA, 81 nt, Homo sapiens
gacacgcaagacgaggcgggccuggaggugcaccaguucuggccgcugguggagauccagugcucgcccgaucucaaguuc

SEQ ID NO: 1323 - RNA, 82 nt, Homo sapiens
gcaccagggguaccucucuacugacuugcaacauacauuugucuugguguguugcaagucgguggagacguacccuuggugc

SEQ ID NO: 1324 - RNA, 69 nt, Homo sapiens
uagcccagggcuuggaguggggcaagguuguuggugauauggcuuccucucccuuccugcccuggcuag

SEQ ID NO: 1325 - RNA, 76 nt, Homo sapiens
ggcuuccuguaucugcugggcuuucugguguuggcagcccaagaugacacccugggcccagcaggagccagaagcc

SEQ ID NO: 1326 - RNA, 80 nt, Homo sapiens
accugaggagccagcccuccucccgcacccaaacuuggagcacuugaccuuuggcuguuggagggggcaggcucgcgggu

SEQ ID NO: 1327 - RNA, 83 nt, Homo sapiens
gucuacucccagggugccaagcuguuucguguucccucccuaggggaucccagguaggggcagcagaggaccugggccuggac

SEQ ID NO: 1328 - RNA, 70 nt, Homo sapiens
gguuucuccuugaggagacauggugggggccggucaggcagcccaugccauguguccucauggagaggcc

SEQ ID NO: 1329 - RNA, 60 nt, Homo sapiens
gagcaggcgaggcugggcugaacccgugggugaggagugcagcccagcugaggccucugc

SEQ ID NO: 1330 - RNA, 85 nt, Homo sapiens
ggagcacucccagguccuccaggccaugagcugcggcccugaugucucuacuccagccacggacugagagugcauaggagugucc

SEQ ID NO: 1331 - RNA, 63 nt, Homo sapiens
guuuuacuugauacccacacugccugggugggacacucaggcaguguggguaucagauaaaac

SEQ ID NO: 1332 - RNA, 75 nt, Homo sapiens
guuuaaagaauacugugaauuucacugucacaaauucaaauaaagugagaguggaauucacaguauuuaaggaau

SEQ ID NO: 1333 - RNA, 80 nt, Homo sapiens
caaauacauagguguuauccuauccauuugccucucucagaaaauagagucaaauggacaggauaacaccuauguauuug

SEQ ID NO: 1334 - RNA, 74 nt, Homo sapiens
ccugcaggaggcagugggcgagcaggcggggcagcccaaugccaugggccugaucucaccgcugccuccuuccc

SEQ ID NO: 1335 - RNA, 70 nt, Homo sapiens
caaagccacugcaagacggauacugucaucuauuccagaagaugacaauguccauuuugcaguggcuuug

SEQ ID NO: 1336 - RNA, 78 nt, Homo sapiens
gggcccagaagggggcgcagucacugacgugaagggaccacaucccgcuucaugucagugacuccugccccuuggucu

SEQ ID NO: 1337 - RNA, 80 nt, Homo sapiens
ugcuucuccuggggucuuccucuacauuuccaccuagacgggccugggucaaaauguagaggaagaccccagaaggagca

SEQ ID NO: 1338 - RNA, 74 nt, Homo sapiens
agcaauuggagaagauugcagaguaaguuccugauuaagaaauggaauuuacucugcaaucuucuccaauugcu

SEQ ID NO: 1339 - RNA, 74 nt, Homo sapiens
ucagugaggucuggggaugaggacaguguguccugaaauucacaggacugacuccucaccccagugcacgagga

SEQ ID NO: 1340 - RNA, 63 nt, Homo sapiens
ccuuggccaccacaccuaccccuugugaaugucgggcaaugggugaugggugugguguccaca

SEQ ID NO: 1341 - RNA, 79 nt, Homo sapiens
uuaugcauauuagcaauacaguacaaauauaguguguuugauuugcacuguaguuguauuguauugccacucuguauaa

SEQ ID NO: 1342 - RNA, 75 nt, Homo sapiens
cuuauccuagacacuaggcaugugagugauugucuuccucacucaaucagucacauaucuagugucuagaaugag

SEQ ID NO: 1343 - RNA, 71 nt, Homo sapiens
cucacaagaucaaucacuugguaauugcugugauaacaacucagcaauuaccaagugauugguuuugugag

SEQ ID NO: 1344 - RNA, 82 nt, Homo sapiens
gcuacggggagcggggaggaagugggcgcugcuucugcguuaucuggaaggagcagcccacuccuguccugggcucuguggu

SEQ ID NO: 1345 - RNA, 80 nt, Homo sapiens
gguuccggagccccggcgcgggcggguucugggguguagacgcugcuggccagcccgccccagccgagguucucggcacc

SEQ ID NO: 1346 - RNA, 67 nt, Homo sapiens
uuuaggagagagaugccgccuugcuccuugaacaggaggagcaaggcggcaucucucugauacuaaa

SEQ ID NO: 1347 - RNA, 72 nt, Homo sapiens
cugcuucaacaacagugacuugcucuccaaugguauccagugauucguugaagaggaggugcucuguagcag

SEQ ID NO: 1348 - RNA, 56 nt, Homo sapiens
gaccgaguggggugagggcaggugguucuucccgaagcagcucucgccucuucguc

SEQ ID NO: 1349 - RNA, 70 nt, Homo sapiens
aaaugugcaucaggccagaagacaugagcccuuuggaaaggucucgugucuucuggcuugaugcacauuu

SEQ ID NO: 1350 - RNA, 82 nt, Homo sapiens
gacaggauuccaguacaggucucucauuuccuucaugauuaggaauacuacuuugaaaugagagaccuguacuguaucuguu

SEQ ID NO: 1351 - RNA, 75 nt, Homo sapiens
guccccauuuuucucccacuaccaggcucccauaagggucgaaugggauccagacagugggagaaaaauggggac

SEQ ID NO: 1352 - RNA, 77 nt, Homo sapiens
auuuuggccaacucugaccccuuagguugaugucagaaugagguguaccaaccuagguggucagaguuggccaaaau

SEQ ID NO: 1353 - RNA, 79 nt, Homo sapiens
ggggaaugaaaguuggcugcaguuaagguggcuaaucagcugauggugccaccuuaacugcagccaauucuaauucccc

SEQ ID NO: 1354 - RNA, 84 nt, Homo sapiens
cauacuuugucuccauguuuccuucccccuucuguauacauguauacaggaggaagggggaaggaaacauggagacaaagugug

SEQ ID NO: 1355 - RNA, 72 nt, Homo sapiens
ggcaguguuuaggccacagccacccauguguagggguggcuacacauggguggcuguggccuaaacacugcc

SEQ ID NO: 1356 - RNA, 51 nt, Homo sapiens
agcuguaccugaaaccaagcaccuguuugugacuuggcuucaguuacuagc

SEQ ID NO: 1357 - RNA, 84 nt, Homo sapiens
acaaugaugacuuguauguuauagauuugugauuacauuaaaacuuaaaauuucacaaaucuauaauaugcaggucaucacugu

SEQ ID NO: 1358 - RNA, 76 nt, Homo sapiens
aagccuggcauauuugguauaacuuaagcaccagguaaaaucuggugcuuaaguuguaccaaguauagccaaguuu

SEQ ID NO: 1359 - RNA, 89 nt, Homo sapiens
gggccuggucauggucaagccagguuccaucaagccccaccagaagguggaggcccaggugagggcuccaggugacggugggcaggguu

SEQ ID NO: 1360 - RNA, 60 nt, Homo sapiens
ggcaggagggcugugccagguuggcugggccaggccugaccugccagcaccucccugcag

SEQ ID NO: 1361 - RNA, 81 nt, Homo sapiens
aguuggugggggagccaugagauaagagcaccuccuagagaauguugaacuaaaggugcccucucuggcuccuccccaaag

SEQ ID NO: 1362 - RNA, 89 nt, Homo sapiens
acgcaaaaugaacugaaccaggagugagcuucguguacauuaucuauuagaaaaugaaguaccuucugguucagcuagucccugugcgu

SEQ ID NO: 1363 - RNA, 90 nt, Homo sapiens
gugucucucuggagacccugcagccuucccacccaccagggagcuuuccaugggcuguggggaaggcgucagugucgggugagggaacac

SEQ ID NO: 1364 - RNA, 58 nt, Homo sapiens
agggccagaggagccuggaguggucgggucgacugaacccagguucccucuggccgca

SEQ ID NO: 1365 - RNA, 55 nt, Homo sapiens
aaucugccagcuuccacaguggcagauuuucccauagugggaagcuggcagauuc

SEQ ID NO: 1366 - RNA, 67 nt, Homo sapiens
gugggaggggagaggcagcaagcacacagggccugggacuagcaugcugaccucccuccugccccag

SEQ ID NO: 1367 - RNA, 72 nt, Homo sapiens
ucuguuuccucauuuaucuguugggaagcuaacugugaccuuagcgucccagcagauaaaugaggaaacaga

SEQ ID NO: 1368 - RNA, 76 nt, Homo sapiens
cgcaggccucuggcggagcccauuccaugccagaugcugagcgauggcuggugugugcugcuccacaggccuggug

SEQ ID NO: 1369 - RNA, 70 nt, Homo sapiens
cccugccagugcugggggccacaugagugugcagucauccacacacaaguggcccccaacacuggcaggg

SEQ ID NO: 1370 - RNA, 76 nt, Homo sapiens
gagggagcuguagagcagggagcaggaagcuguguguguccagcccugaccuguccuguucugcccccagccccuc

SEQ ID NO: 1371 - RNA, 76 nt, Homo sapiens
ggucgcuuaaaucccaaugcuagacccgguggcaaucaaggucuagccaccaggucuagcauugggauuuaagccc

SEQ ID NO: 1372 - RNA, 70 nt, Homo sapiens
cucgggcccgaccgcgccggcccgcaccucccggcccggagcugcgggcugcggucagggcgaucccggg

SEQ ID NO: 1373 - RNA, 69 nt, Homo sapiens
ugcagugccuaauuugaacaccuucgguauucaucaaaaauaccaaaggugcucaaauuagacauugca

SEQ ID NO: 1374 - RNA, 47 nt, Homo sapiens
aggcagguuaucugggcugccaucucccacuggcugcuugccugccu

SEQ ID NO: 1375 - RNA, 81 nt, Homo sapiens
cugcacaggaugcgaggaugcugacagugccucacagccgcacaggaccgaggaugcugacggugccucacagccacacag

SEQ ID NO: 1376 - RNA, 87 nt, Homo sapiens
ggucgcauuucuccuucuuaccagcgcguuuucaguuucauagggaagccuuuccaugaaacuggagcgccuggaggagaaggggcc

SEQ ID NO: 1377 - RNA, 74 nt, Homo sapiens
gggaggaagaagggaggaggagcggaggggcccuugucuucccagagccucucccuuccuccccucccccuccc

SEQ ID NO: 1378 - RNA, 63 nt, Homo sapiens
gccaaggacugauccucucgggcagggagucagaggggaccgcccgagaggauccgucccugc

SEQ ID NO: 1379 - RNA, 90 nt, Homo sapiens
cgggcggggcggguccggccgccuccgagcccggccggcagcccccggccuuaaagcgcgggcuguccggaggggucggcuuucccaccg

SEQ ID NO: 1380 - RNA, 85 nt, Homo sapiens
ucaggcaaagggauauuuacagauacuuuuuaaaauuuguuugaguugaggcagauuaaauaucuguauucuccuuugccugcag

SEQ ID NO: 1381 - RNA, 69 nt, Homo sapiens
gcuggccggaugggacaggaggcaugaaugagccaucuuuccaaugccuuucugucuuuucugguccag

SEQ ID NO: 1382 - RNA, 82 nt, Homo sapiens
guaaucacaucuaaagacuagacuucgcuaugaccaggccauaguaaacaucauaguaugucuagucuuuagguuugauuac

SEQ ID NO: 1383 - RNA, 62 nt, Homo sapiens
gugaguggggcucccgggacggcgcccgcccuggcccuggcccggcgacgucucacgguccc

SEQ ID NO: 1384 - RNA, 71 nt, Homo sapiens
gugucugugccggucccaggagaaccugcagaggcaucgggucagcggugcuccugcgggccgacacucac

SEQ ID NO: 1385 - RNA, 54 nt, Homo sapiens
agggaaggaggcuuggucuuagcacggggucuaaggcccgggcuuuccucccag

SEQ ID NO: 1386 - RNA, 82 nt, Homo sapiens
uggcuggcugagguuuggggaggauuugcuggugcuagagaggaaagcagacccuacccaaccccacgcccuacuacagcca

SEQ ID NO: 1387 - RNA, 61 nt, Homo sapiens
ccugcggggacaggccagggcaucuaggcugugcacagugacgccccuccugcccccacag

SEQ ID NO: 1388 - RNA, 56 nt, Homo sapiens
cgcucgggcggaggugguugagugccgacuggcgccugacccacccccucccgcag

SEQ ID NO: 1389 - RNA, 74 nt, Homo sapiens
cccggagccagaggacccguagcugcuagaagggcagggguguggcuucugggggcuggucuucagcucuggcg

SEQ ID NO: 1390 - RNA, 72 nt, Homo sapiens
agugucuccuuguggaucucaaggaugugcuuccacauagcagcauguucuucagauggacaaggagacacu

SEQ ID NO: 1391 - RNA, 83 nt, Homo sapiens
auaucuacacaaggccaaaggaagagaacagauauauccacaguacacuuggcuguucucuuucuuuagccuuguguagauau

SEQ ID NO: 1392 - RNA, 89 nt, Homo sapiens
acgcgccugaugcggaccuggguuagcggagugaggcccaguggucaccgccgcccuccgcagguccagguugccgugcgcaugugccu

SEQ ID NO: 1393 - RNA, 72 nt, Homo sapiens
agauucagcuuucccuucagagccuggcuuuggcaucuaugaaagccaggcucugaagggaaaguugaaucu

SEQ ID NO: 1394 - RNA, 78 nt, Homo sapiens
gggauaaaaugcagggaggcgcucacucucugcugccgauucugcaccagagaugguugccuuccuauauuuuguguc

SEQ ID NO: 1395 - RNA, 77 nt, Homo sapiens
uuccagcccgaggccucugugacgucacggugucugcgggaggagaccaugacgucacagaggcuucgcgcucugag

SEQ ID NO: 1396 - RNA, 71 nt, Homo sapiens
ggugagugggagccgguggggcuggaguaagggcacgcccggggcugccccaccugcugaccacccucccc

SEQ ID NO: 1397 - RNA, 83 nt, Homo sapiens
cauuuaggacuagauguuggaauuagacagaaaaaaguuagacacaaaaaauugugucuaauuccaacaucuaguccuaaaug

SEQ ID NO: 1398 - RNA, 80 nt, Homo sapiens
gccaugguguuuagauugaacaugaaguuagaauucuuaaguaucaaaacuaaauucauguucaaucuaaaccccauggc

SEQ ID NO: 1399 - RNA, 82 nt, Homo sapiens
ggacaaggugugcaugccugacccguugucagaccuggaaaaagggccggcugugggcagggagggcaugcgcacuuugucc

SEQ ID NO: 1400 - RNA, 75 nt, Homo sapiens
cugauaccccaaaucuugaucagaagccuugaucagaagcuaggaaggcuucugaucaagauuuguggugucaag

SEQ ID NO: 1401 - RNA, 92 nt, Homo sapiens
ccugucccuccugcccugcgccugcccagcccuccugcucuggugacugaggaccgccaggcaggggcuggugcugggcggggggcggcggg

SEQ ID NO: 1402 - RNA, 88 nt, Homo sapiens
ucuuccccauggauguggaaggaguuaucugucaccagucagauaacugucaccagucaguuaacuccuuucacacccauggggaaga

SEQ ID NO: 1403 - RNA, 77 nt, Homo sapiens
uggugauuuugaacguagcuauccaccacucagccuggaaaaagcugagugauugauagcuauguucaaaaucacca

SEQ ID NO: 1404 - RNA, 76 nt, Homo sapiens
cugaagcuccuucugaaagagcaguugguguuuauuuuuuacuaaauagcaauugcucuuuuggaaggaacuugag

SEQ ID NO: 1405 - RNA, 78 nt, Homo sapiens
acaugggcccgcgggcgcuccuggccgccgcccgacuucggggccagccgggggcagagcgcgcgggagcccgagcgu

SEQ ID NO: 1406 - RNA, 74 nt, Homo sapiens
aaacuuugauucucucuggaucccauggauaugggaacugugauguccaggagauccagagagaaucagaguuu

SEQ ID NO: 1407 - RNA, 77 nt, Homo sapiens
gaggagaggugggauggagagaagguaugagcuaaaaauccccaagcucugccauccucccuccccuacuucucccc

SEQ ID NO: 1408 - RNA, 58 nt, Homo sapiens
gaguuauggggucaucuauccuucccuuggaaaaugaucugagaugacacuguagcuc

SEQ ID NO: 1409 - RNA, 74 nt, Homo sapiens
gcucuagccuaauuuuagaucuggucugcuucaguuucacuccaagcagacuugaccuacaauuagccuagagc

SEQ ID NO: 1410 - RNA, 74 nt, Homo sapiens; identical to SEQ ID NO: 1409

SEQ ID NO: 1411 - RNA, 78 nt, Homo sapiens
gugauugccucugaucaggcaaaauugcagacugucuucccaaauagccugcaacuuugccugaucagaggcagucac

SEQ ID NO: 1412 - RNA, 78 nt, Homo sapiens
ugcuccccagccuuucuaugcuccuguucugcuuuauuucaucaaagcagaacaggagcauagaaaggcuggggagca

SEQ ID NO: 1413 - RNA, 78 nt, Homo sapiens
ugcuccccagccuuucuaugcuccuguucugcuuugaugaaauaaagcagaacaggagcauagaaaggcuggggagca

SEQ ID NO: 1414 - RNA, 76 nt, Homo sapiens
uauauuguugucugguauguaguagguaauaacugacaaacagacaauugccuaacaugugccagaaaacaacaua

SEQ ID NO: 1415 - RNA, 75 nt, Homo sapiens
auuaagcuuuuaauuuuuuguuucggucacucuugauagcagacauugacugaaacaaaaaauuaaaagcuuuau

SEQ ID NO: 1416 - RNA, 80 nt, Homo sapiens
cuauaugcaguggaccaggauggcaagggcucuccugaaaggacaguagagcccuugccauccugguccacugcauauag

SEQ ID NO: 1417 - RNA, 80 nt, Homo sapiens
cuauaugcaguggaccaggauggcaagggcucuacuguccuuucaggagagcccuugccauccugguccacugcauauag

SEQ ID NO: 1418 - RNA, 86 nt, Homo sapiens
uagaauauuucggcauucuagaugagagauauauauauaccucauauguauaugguauaccucaucuagaaugcuguaauauucua

SEQ ID NO: 1419 - RNA, 80 nt, Homo sapiens
ucacauguccaauucuguaaaggaagaagagguaagaagaagugaagcccucuucuuccuuugcagaguugaauaugugg

SEQ ID NO: 1420 - RNA, 83 nt, Homo sapiens
uaaaugucuuacugcuuuuacuguucccuccuagaguccauucuuuacucuaggagggaauaguaaaagcaguaagacauuua

SEQ ID NO: 1421 - RNA, 81 nt, Homo sapiens
ggccagugccagggggucaggcucaaggaccagcccaaaggccaggccugacccuugagccugaucccuagcacugauccc

SEQ ID NO: 1422 - RNA, 76 nt, Homo sapiens
aggugcacgcucuagcggggauuccaauauugggccaauucccccaauguuggaauccucgcuagagcgugcacuu

SEQ ID NO: 1423 - RNA, 79 nt, Homo sapiens
auugcccaguucuggauaugaagacaaucaagaaaagauuugguguucuugauugucuucauaucuagaacugggcagu

SEQ ID NO: 1424 - RNA, 82 nt, Homo sapiens
gggaaagcggagggcgcgcccagcucccgggcugauugcgcuaacaguggccccgguguuggggcgcgucugccgcugcccc

SEQ ID NO: 1425 - RNA, 77 nt, Homo sapiens
ugacugggcugaggagaugcugggacugagagugucaugguggagccuccgucccugcucauccucuccgcauguug

SEQ ID NO: 1426 - RNA, 73 nt, Homo sapiens
guagguggggacgcggcggcgcugcuccuccgcugccgccgggagagucggcgacgccgccagcuccgcgcgc

SEQ ID NO: 1427 - RNA, 80 nt, Homo sapiens
gggcauggccugagaccaggacuggaugcaccacucucccugugaugaggugaagccagcucuggucugggccauuucac

SEQ ID NO: 1428 - RNA, 84 nt, Homo sapiens
cgguccagacguggcggggguggcggcggcaucccggacggccugugagggaugcgccgcccacugccccgcgccgccugaccg

SEQ ID NO: 1429 - RNA, 80 nt, Homo sapiens
aaugaaggauuacggaccagcuaagggaggcauuaggauccuuauucuugccucccuuaguuggucccuaauccuucguu

SEQ ID NO: 1430 - RNA, 82 nt, Homo sapiens
caugcuacguauguauacaccugauauguguauguguaaauacauauccacacacauagcagguguauauauagguagccug

SEQ ID NO: 1431 - RNA, 79 nt, Homo sapiens
caaugugacaucgcuuuaccauucauguucacugaaagguagauuuuaaaaacaugaaugguaaagcgaugucacauug

SEQ ID NO: 1432 - RNA, 84 nt, Homo sapiens
uaagaacuggauaugaugacugaaauaagcuccauaucaaugagaauuucaaugggauuaugugcagucaauguccaguaauua

SEQ ID NO: 1433 - RNA, 74 nt, Homo sapiens
gcagcccggugagcgcucgcuggccuggcagugcgucggaagaacagggcggguggggccgcgcacaucucugc

SEQ ID NO: 1434 - RNA, 87 nt, Homo sapiens
uuucuccucgcugcccgcacauccugcuccacagggcagagggaggccaagaagaccucugcacugugaguuggcuggcuggaggaa

SEQ ID NO: 1435 - RNA, 77 nt, Homo sapiens
uuuuaacaucuggcuaucucacgagacuguauguccuaacagugcuuguagucucaugagauagccagauguuaaaa

SEQ ID NO: 1436 - RNA, 89 nt, Homo sapiens
ugauauggaagaaauccagaaguggcuaauaauauugacacuauaacaauaaugucaauauuauuagccacuucuggauuuaugaauca

SEQ ID NO: 1437 - RNA, 81 nt, Homo sapiens
uaaauuugugucuauacucugucacuuuacuuuuggccucaagucauugcaguaaaguggcagaguauagacacaaauuua

SEQ ID NO: 1438 - RNA, 71 nt, Homo sapiens
gacucagaagacagagugccacuuacugaaagguuuuuucucucaguaaguggcacucugucuucugaguu

SEQ ID NO: 1439 - RNA, 75 nt, Homo sapiens
aaguacaacuucgguauacuuugugaauuggcuuuuacaaaagaccaacucacgaaguauaccgaagucauacuu

SEQ ID NO: 1440 - RNA, 74 nt, Homo sapiens
acugcuaauaucuaaaugcagcaugccaguccugagaugcagggacuggcaugcugcauuuauauauuagcagu

SEQ ID NO: 1441 - RNA, 80 nt, Homo sapiens
ggagaaaggaguggaccgaggaaggaaggaaggcaaggcugucuguccauccguccgucuguccaccuaccugucagucc

SEQ ID NO: 1442 - RNA, 82 nt, Homo sapiens
uugaggcuugguuuucuuauguguaaaauguaauaacauuucuuauguuuaaaacacuuuacacaagaaaaccaaggcucaa

SEQ ID NO: 1443 - RNA, 80 nt, Homo sapiens
cugacuggcuuguauggagguucuagaccauguuaguguucaagucuacauggauggaaaccuucaagcaggccaagcag

SEQ ID NO: 1444 - RNA, 74 nt, Homo sapiens
agugggauuuaacauaauaguguggauugaaucacacacacauuucaacccacacuaugauguuaaaucccauu

SEQ ID NO: 1445 - RNA, 73 nt, Homo sapiens
ucaguguauuuggacgguaagguuaagcaaggugcgucguaucuugcuuaaccuugcccucgaaauacacuga

SEQ ID NO: 1446 - RNA, 91 nt, Homo sapiens
auagaaaauaaaacacauacugcuguauugucagguagugauaggauuuaucacuaccugacaauacaguauguguuuguuuuauauauuu

SEQ ID NO: 1447 - RNA, 103 nt, Homo sapiens
cugaagaguagaguguguggucccaguucagaaguguuccugaguaacuugugcuuauaacucaggacacuucugaacuuggaccauacaggucucccugcuu

SEQ ID NO: 1448 - RNA, 100 nt, Homo sapiens
agcucagggcggcugcgcagagggcuggacucagcggcggagcuggcugcuggccucaguucugccucuguccagguccuugugacccgcccgcucuccu

SEQ ID NO: 1449 - RNA, 97 nt, Homo sapiens
ucuuccucucuguccucuggaauuugguuucugaggcacuuaguaggugauagcaugacugacugccucacugaccacuuccagaugaggguuacuc

SEQ ID NO: 1450 - RNA, 99 nt, Homo sapiens
augaguuugcuuugugucauccucacaacaaccuugcaggguagagaugauuuuuccuacuuuucuagguuguugggggcuggggcagggggaacagag

SEQ ID NO: 1451 - RNA, 107 nt, Homo sapiens
ggcacuugcuuggggguuagugaggacagggcaaauucacgagauuggguugugcagaggcugacacuuggauuuuccugggccucaggacuuccuuucagacaugg

SEQ ID NO: 1452 - RNA, 110 nt, Homo sapiens
aaccauuagggggcugugguuugccagggcaggagguggaagggagccccauuuacagugguaacuuccuuucccuuuccauccuggcaggcuucagagaacuuuaccag

SEQ ID NO: 1453 - RNA, 95 nt, Homo sapiens
gguaaaccuuggugacuaauuagagucuggcugauaugguuugacacagagcuaaaucauaugaaccaaacucuaauuagucaauaauuucuguu

SEQ ID NO: 1454 - RNA, 94 nt, Homo sapiens
gggcugaccccuagggucaggugaggcccuuggggcacaguggugccaucuccccugugcucccagggccucgccugucccuugaggucggccc

SEQ ID NO: 1455 - RNA, 100 nt, Homo sapiens
gaccagaaguguuuuggauuuuggacuuuuucagauuuggggauauuugcauuauacuuauccuaaaucugaaaguccaaaaccugaaaugaccaauaag

SEQ ID NO: 1456 - RNA, 120 nt, Homo sapiens
gauccagggaacccuagagcagggggauggcagagcaaaauucauggccuacagcugccucuugccaaacugcacuggauuuugugucucccauuccccagagcugucugaggugcuuug

SEQ ID NO: 1457 - RNA, 103 nt, Homo sapiens
agaugguauugaguggaugcuguuauauauacagccaugcacucuguaguuuggguacacagugcauggcuguauauauaacacuauccauucaucuuucagc

SEQ ID NO: 1458 - RNA, 100 nt, Homo sapiens
gaagcgcuugccuagacgagacacagugcauaaaaacaacuuuugggggacagguauguuuucuugcagcugcgguuguaaggucuuggcaagacaagca

SEQ ID NO: 1459 - RNA, 76 nt, Homo sapiens
agcuuucuacggguuuguagcuuugcuggcauguuaaguguuguccuacagucgcaagcauaagaaagagaaagua

SEQ ID NO: 1460 - RNA, 79 nt, Homo sapiens
cccaucagggcucagggauuggauggaggugaugggggcaggggaugggucucacccucccuucuuccugggcccucag

SEQ ID NO: 1461 - RNA, 84 nt, Homo sapiens
aaggacuucagugggauuucugaguagcauccuuggaaucugcacucaagggaugcuacucggaaaucccacugaaguccuuuu

SEQ ID NO: 1462 - RNA, 85 nt, Homo sapiens
ucugagguacccggggcagauugguguagggugcaaagccugcccgcccccuaagccuucugcccccaacuccagccugucagga

SEQ ID NO: 1463 - RNA, 93 nt, Homo sapiens
gacuguggcgacggagacgacaagacugugcuggucgcggguugugggguuuaggucaccggcaggggucuggagucccuggagguuagggcu

SEQ ID NO: 1464 - RNA, 88 nt, Homo sapiens
aucccagaucagaugccaaagccaguggggacuggacaacaugaugagcccaaaccaauccacgcugagcuuggcaucugauuuggga

SEQ ID NO: 1465 - RNA, 100 nt, Homo sapiens
cccgccagguccacaugccagagugucaacgugacccagccagccuccuuccugagcuaggaggauuaggaaaugaggcuggcuaggagcacagccaggg

SEQ ID NO: 1466 - RNA, 85 nt, Homo sapiens
aaaagaaaaaaaucagugaaugccuugaaccuaacacacugccuuuuaugugguagguacagugggcucacugaaacauucaacu

SEQ ID NO: 1467 - RNA, 88 nt, Homo sapiens
cugggauuacaggcgugaaccaccgcgcccggccuaacuuuuaagaaacgucggcccgggagcgguggcucacgccuguaaucccagc

SEQ ID NO: 1468 - RNA, 70 nt, Homo sapiens
aguagaggugggguuucaccauguuggucaggcuggucucaaacuccugaccucaggugauccauccacc

SEQ ID NO: 1469 - RNA, 119 nt, Homo sapiens
ccaugaggagcuggcagugggauggccuggggguaggagcguggcuucuggagcuagaccacauggguucagaucccagcggugccucuaacuggccacaggaccuugggcagucagcu

SEQ ID NO: 1470 - RNA, 120 nt, Homo sapiens
ucagccagcuuaugacuugacccucucaccugauuucuaccaaccuuuccucagcugauuucuuucuggggagagauugguagaaaucaggugagagggucaugccauaagcuggcuaac

SEQ ID NO: 1471 - RNA, 76 nt, Homo sapiens
gacuaagggugggaugagggauugaaguggagcaggaaugcgcuuuucuccacugaauccucuuuuccucaggugg

SEQ ID NO: 1472 - RNA, 113 nt, Homo sapiens
gggaggcauggaaauuucucugguuucaauggguacgauuauuguaagcaggauccauucaauaaucggacccauuuaaaccggagauuuuaaaagacaggaauagaauccca

SEQ ID NO: 1473 - RNA, 114 nt, Homo sapiens
ggcccgccuuuuaggggccucgcugucugggcacaggcggauggacaggcuggccucuggaugaccugccaaccgucagagcccagacccacguggccucaguuggggaccagg

SEQ ID NO: 1474 - RNA, 80 nt, Homo sapiens
ggucauacccuggcuccagcccugucacaugguuaauguuccacagccagugacugagcuggagccagggccacugcccc

SEQ ID NO: 1475 - RNA, 120 nt, Homo sapiens
aguuggccaggaccccaagcccccagcacuucauucuugcuguccucuccuggucugggaggauagaagagaggauaggaagaaugaagugcugggcgcuuagggggauccuggccaacu

SEQ ID NO: 1476 - RNA, 92 nt, Homo sapiens
uuaguuccagccuccuggcucaccuggaaccauuucuccugggaagcaugguagccaggagaguggauuccagguggugagggcuugguacu

SEQ ID NO: 1477 - RNA, 109 nt, Homo sapiens
ccuaggaaaggcugcugguaacugggauggggguuggggggagguaagaagucucugacuccuccucuaccucaucccaguuccaucaccugaaguggaccucuuggga

SEQ ID NO: 1478 - RNA, 120 nt, Homo sapiens
auuucuuuggguuaacuuaaacucagcccuucuaggcccauucuuuucacucaggaauuggauaagcuuuucugagggguuuggaaugggauggcagggagagucaccagacaccaugaa

SEQ ID NO: 1479 - RNA, 115 nt, Homo sapiens
gagcaaaaaccagagaacaacaugggagcguuccuaaccccuaaggcaacuggaugggagaccugacccauccaguucucugagggggcucuuguguguucuacaagguuguuca

SEQ ID NO: 1480 - RNA, 115 nt, Homo sapiens
ucugaggagaccugggcugucagaggccagggaaggggacgaggguuggggaacaggugguuagcacuucauccucgucucccucccagguuagaagggccccccucucugaagg

SEQ ID NO: 1481 - RNA, 112 nt, Homo sapiens
uaugggauuccacagacaaugaguaucaauggcacaaacucauucuugaauuuuugccaguucaagaagagacugagucaucgaaugcucuaaaugucacuucaccucaugu

SEQ ID NO: 1482 - RNA, 113 nt, Homo sapiens
aucugacacaaaaugugaaccaagcaauucucaaaggagccucccaggaaauucacuuuaggaaguccuaggaggcuccucugagaguugcuaaaacaaaacauugagagucc

SEQ ID NO: 1483 - RNA, 137 nt, Homo sapiens
agccagacaagagggucauggggagucacugucaacccagagcaggcacugccccugcgaccagccuggggcaucgguuggggugcaggggucugcuggugaugcuuuccaucucuuugcuuuguccugauuguagc

SEQ ID NO: 1484 - RNA, 58 nt, Homo sapiens
uaugguacuccuuaagcuaacaggccccugucaccauuagcuuaaggaguaccagauc

SEQ ID NO: 1485 - RNA, 58 nt, Homo sapiens
ugcuggcucauuucauaugugugcugagaaaauucacacauaugaagugagccagcac

SEQ ID NO: 1486 - RNA, 60 nt, Homo sapiens
agccuuccaggagaaauggagacccuauacauaccuguuuccaugccuccuagaaguucc

SEQ ID NO: 1487 - RNA, 68 nt, Homo sapiens
uaggcacacuuaaaguuauagcuacaucaguuauaacuauaucaguuaaaacuuuaagugugccuagg

SEQ ID NO: 1488 - RNA, 59 nt, Homo sapiens
aaacuaauauacccauauucuggcuaggugaucaucagaauauggguauauuaguuugg

SEQ ID NO: 1489 - RNA, 59 nt, Homo sapiens
aaacuaauauacccauauucugaugaucaccuagccagaauauggguauauuaguuugg

SEQ ID NO: 1490 - RNA, 60 nt, Homo sapiens
cagggaaaugggaagaacuagauuugaauccagaccuuuaguucuucccuuugcccaauu

SEQ ID NO: 1491 - RNA, 59 nt, Homo sapiens
ugaaguaccagcuacucgagaggucagaggauugcuccugaauagcugggacuacaggu

SEQ ID NO: 1492 - RNA, 59 nt, Homo sapiens
uauccagcuuguuacuauaugcuuuuuaaauggggcacagagugacaagcugguuaaag

SEQ ID NO: 1493 - RNA, 53 nt, Homo sapiens
auggucaccuccgggacucagcccugugcugagccccgggcagugugaucauc

SEQ ID NO: 1494 - RNA, 63 nt, Homo sapiens
acuggcauuagugggacuuuuuuuuuuuuuuuuuuuaauguuaaaagucccacuaaugccagc

SEQ ID NO: 1495 - RNA, 60 nt, Homo sapiens
ggcugggugcucuugugcagugagcaaccuacacaacugcacauggcaaccuagcuccca

SEQ ID NO: 1496 - RNA, 54 nt, Homo sapiens
uugccauacauagacuuuauuguguugaucaacaauaaaguucauguauggcaa

SEQ ID NO: 1497 - RNA, 65 nt, Homo sapiens
ugggagcuaagcuauggguauacugagcuuauguaugcaucugcauacccauagcuuagcuccca

SEQ ID NO: 1498 - RNA, 84 nt, Homo sapiens
gcauuggguuagcagguuagcccagcauuucccuuccuggacacacaggaggagaaaugcuggacuaaucugcuaauccaaugc

SEQ ID NO: 1499 - RNA, 75 nt, Homo sapiens
aguuuuugaagaguauugccacccuuucuagucccuauuagacuagaaaggguggcaauaccucuuccaaaaacu

SEQ ID NO: 1500 - RNA, 60 nt, Homo sapiens
gaagagguauugccacccuuucuagucuaauagggacuagaaaggguggcaauacucuuc

SEQ ID NO: 1501 - RNA, 76 nt, Homo sapiens
ggcccaugggucuuauccugcaaggugcugcagagacgaggccuguagcaccuugcaggauaaggucuacugggcc

SEQ ID NO: 1502 - RNA, 76 nt, Homo sapiens
ggagcuuguuacagaugcagauucucugacuucuuacugcaccagugaagucaggaucugcauuugaauaagaccc

SEQ ID NO: 1503 - RNA, 65 nt, Homo sapiens
gcugaacucuagccugagcaacagagugagauggucuuguuuuguugcccaggcuggaguccagu

SEQ ID NO: 1504 - RNA, 79 nt, Homo sapiens
cucuacaucacagcccagcaguuaucacgggccccuccccucaaugggcccgugauaacugcagggcugugauguagag

SEQ ID NO: 1505 - RNA, 77 nt, Homo sapiens
ccucacuuaucugacucugaaaucuucuaaaugguacccacuuuauuuagaacguuuuagggucaaauaaguacagg

SEQ ID NO: 1506 - RNA, 83 nt, Homo sapiens
gaaacacuuugccuuuuuacaggaguuuauuauguuuuggacauagaaacauaacaaacaccuguaaaacagcaaaguguuuc

SEQ ID NO: 1507 - RNA, 78 nt, Homo sapiens
agcgugguagcauacaccuguaguccuagauacucaggagggugaguaucuaggacuacaggugugugcuaccacgcu

SEQ ID NO: 1508 - RNA, 73 nt, Homo sapiens
cuuuuaauuucagcuacuaccucuauuaggauuugggaguuauacuaauagagguaauaguugaaauuaagag

SEQ ID NO: 1509 - RNA, 68 nt, Homo sapiens
ggacaagcuugcucugagcuccgagaaagcugacagacagcugcuugguguucagagcuugucugucc

SEQ ID NO: 1510 - RNA, 69 nt, Homo sapiens
gacaguacaaauaauaccacaguggguguaccucauguguguacacccugugauauuauuuguaauauc

SEQ ID NO: 1511 - RNA, 59 nt, Homo sapiens
uacaaauaauaccacaguggguguaccucauguguguacacccugugauauuauuugua

SEQ ID NO: 1512 - RNA, 87 nt, Homo sapiens
gauauuaugaauaauaucacaguagguguucacacauaauguguacaccauguguguacacccaugugauauuugaaguaguauguc

SEQ ID NO: 1513 - RNA, 91 nt, Homo sapiens
uauaacauuguauauacccacugugauauuaagaguaauagcucucuagguuauuaugaauaauaucacaguagguguacacaauguugua

SEQ ID NO: 1514 - RNA, 77 nt, Homo sapiens
uguguacaccaacugugauauuaggaguccuauuuauuuuuaggauauuaggaauaauaucacaguagguguacaca

SEQ ID NO: 1515 - RNA, 73 nt, Homo sapiens
cugggaaguuaguucauuucagucugugcugugagcuagccagcaguggcucugaaaugaacucaaacucuag

SEQ ID NO: 1516 - RNA, 76 nt, Homo sapiens
gccaacugcagaucaugggacugucucagccccauauguaucugaaggcugagaagucccaugauccgcacuuggc

SEQ ID NO: 1517 - RNA, 85 nt, Homo sapiens
caaggccuaucuaucuagauucuucuuggccucucugagcaugcauuccugagacuccaagaagaaucuagacagauaggccuug

SEQ ID NO: 1518 - RNA, 85 nt, Homo sapiens
gugcucauuuaaguagucugaugccuacuacugaugacauacaauguaagugcucauuuaggcgucagacuaccuaaaugagcac

SEQ ID NO: 1519 - RNA, 78 nt, Homo sapiens
agcauauucucaaguaguuucaugauaaaggguguaugagagaucaacccuuuaucaugaaacgcuugaggauacgcu

SEQ ID NO: 1520 - RNA, 72 nt, Homo sapiens
cugugcaccugggggagugcagugauuguggaaugcaaagucccacaaucacuguacuccccaggugcacag

SEQ ID NO: 1521 - RNA, 90 nt, Homo sapiens
cuguaccccugccccaacaaggaaggacaagaggugugagccacacacacgccuggccuccugucuuuccuuguuggagcagggauguag

SEQ ID NO: 1522 - RNA, 71 nt, Homo sapiens
uuaauuaaugcauuaaauuauugaaggcccuugggcaccccaggccuucaauaauuuaaugcauuuauuga

SEQ ID NO: 1523 - RNA, 82 nt, Homo sapiens
gauuggacuuuauugucacguucugauugguuagccuaagacuuguucugauccaaucagaacaugaaaauaacguccaauc

SEQ ID NO: 1524 - RNA, 82 nt, Homo sapiens; identical to SEQ ID NO: 1523

SEQ ID NO: 1525 - RNA, 84 nt, Homo sapiens
gccucaacuccugggauauguugcugauccaaccugaaauccuucuguagguugagucagcaacauaucccaugacuuuugggu

SEQ ID NO: 1526 - RNA, 56 nt, Homo sapiens
uugccguccccuuccucgucuuuuccccucaggagaagucgggaagguggcggcgg

SEQ ID NO: 1527 - RNA, 77 nt, Homo sapiens
ugaucuuguuuaggccaucaucccauuaugcuaaguccaugggcaaacauaacaggaugauggccuaaacaagacca

SEQ ID NO: 1528 - RNA, 89 nt, Homo sapiens
uccccauuuacacaggccaugagccccgaaacacccaucccaggauugcugauggguguuucggggcucauggccuguguaaaugggga

SEQ ID NO: 1529 - RNA, 80 nt, Homo sapiens
agcuaggucuucuggauaacaugcugaagcuucuacgucauucagcacuugcuucagcauguuuuccagaggaucuagcu

SEQ ID NO: 1530 - RNA, 81 nt, Homo sapiens
uguaagaacacguuugaaugcuguacaaggcacauaugugaacauuguaccacauguacagcuuucaaacaugcucuuaua

SEQ ID NO: 1531 - RNA, 85 nt, Homo sapiens
auuacagacaugagcgacugugccugaccaaaagucaacauuaaacaacaaaucuuggccaggcacaguggcucaugccuguaau

SEQ ID NO: 1532 - RNA, 80 nt, Homo sapiens
gguuggcuauaacuaucauuuccaagguugugcuuuuaggaaauguuggcuguccugcggagagagaauggggagccagg

SEQ ID NO: 1533 - RNA, 55 nt, Homo sapiens
gggggcuggggcgcggggaggugcuaggucggccucggcucccgcgccgcacccc

SEQ ID NO: 1534 - RNA, 60 nt, Homo sapiens
ccugcgagucuccggcgguggcuuguggcugagugucacgcugcuggcgcaggcucggcc

SEQ ID NO: 1535 - RNA, 79 nt, Homo sapiens
uggugaccccugggcuagggccugcugcccccugcccagugcaggaggguggagggucacuccuuagguggucccagug

SEQ ID NO: 1536 - RNA, 103 nt, Homo sapiens
gggucacuucuagccucuccgguuccagucccuggagcucugugccuuuggguccuggugagcucuuguugauugcagugggagauggggagaauugccuuca

SEQ ID NO: 1537 - RNA, 78 nt, Homo sapiens
guuucugcugccggccaaggcucuggguccggcuuacucccuagcuuacuguccucagaacccccgccaccacagaag

SEQ ID NO: 1538 - RNA, 71 nt, Homo sapiens
gggugggggcuggugcagggaugggcuuugcuacugcuccucaucacacugcaccuuagcugcugccugga

SEQ ID NO: 1539 - RNA, 89 nt, Homo sapiens
uagauguugguccaaacugaaaguugaugagucacugugccucucgggguagugaguuaucagcuacagugagagagcaguguuuggcc

SEQ ID NO: 1540 - RNA, 107 nt, Homo sapiens
uaccaaccccauggaauuuuuacucaccuucagucaacugauuugcucuuugguggagauauucagaggcuagguggagauagagguagccuugagggugggugugg

SEQ ID NO: 1541 - RNA, 95 nt, Homo sapiens
gacaccacaugcuccuccaggccugccugcccuccaggucauguuccagugucccacagaugcagcaccacggcccaggcggcauuggugucacc

SEQ ID NO: 1542 - RNA, 113 nt, Homo sapiens
agcaugacagaggagagguggagguaggcgagaguaauauaauuucuccaggagaacaucugagaggggaaguugcuuuccugcccuggcccuuucacccuccugaguuuggg

SEQ ID NO: 1543 - RNA, 82 nt, Homo sapiens
ccugcguagaaagggaagagcuguacggccuucgcgcuaguuuguuuguguuaaggcugacgcucccuauuucuccucagug

SEQ ID NO: 1544 - RNA, 82 nt, Homo sapiens; identical to SEQ ID NO: 1543

SEQ ID NO: 1545 - RNA, 100 nt, Homo sapiens
gcagaggagaaagagccaccgccugagcuagcuguggacagaggcaaaacucuaacuucagcugguuuugagugagaagugggucucuguuaaaaugcua

SEQ ID NO: 1546 - RNA, 62 nt, Homo sapiens
uccuagaccuaguaucaguggccaaagaaacuuuuuuggaagcuuggaccaacuagcuggcu

SEQ ID NO: 1547 - RNA, 66 nt, Homo sapiens
gccugcggcucugggaaugccggucuggggcugguugucuagugcgggcguucccguucgcgggga

SEQ ID NO: 1548 - RNA, 97 nt, Homo sapiens
ccaccacggugcuggcaccagggccucugccccguaggacaccgaggcuuaugaauaggagcagugccggccaaggcgccggcaccaucuuggugau

SEQ ID NO: 1549 - RNA, 109 nt, Homo sapiens
uugaagaauacgucugguugauccaguccacuuaauucugagaaaguccacagacuggaucgggucuuggauuuuagcuggauucauugacugggcuauauuugucaua

SEQ ID NO: 1550 - RNA, 106 nt, Homo sapiens
guaaaaagaguccagagucugggaagguggaaagggagcaggagcaucgucuuuaagagggucagguaccuuugcucuuauaucagaggcugugggcuuccuacag

SEQ ID NO: 1551 - RNA, 110 nt, Homo sapiens
agcguccaggcugggccgcaggaccgggcgcggagccucgcagggucgggcucgggcucccuaaccgucuccgcuucuuccgccagucgguggccgggcuggcggcgcgg

SEQ ID NO: 1552 - RNA, 110 nt, Homo sapiens
gucuaccaggugugggcccagcuuuacauaguucaugcugaggccgggauuucaugcagaaaacugguugcaaaaggugcugaaggggcugggggagcacaagggagaag

SEQ ID NO: 1553 - RNA, 55 nt, Homo sapiens
aggagguugggaagggcagagaugagcauaaaguuuuugccuuguuuuucuuuuu

SEQ ID NO: 1554 - RNA, 49 nt, Homo sapiens
ggugaggcgggggggcgagcccugaggggcucucgcuucuggcgccaag

SEQ ID NO: 1555 - RNA, 51 nt, Homo sapiens
agagaugaagcgggggggcggggucuugcucuauugccuacgcugaucuca

SEQ ID NO: 1556 - RNA, 64 nt, Homo sapiens
ccccgggcccggcguucccuccccuuccgugcgccaguggaggccgggguggggcggggcgggg

SEQ ID NO: 1557 - RNA, 64 nt, Homo sapiens; identical to SEQ ID NO: 1556

SEQ ID NO: 1558 - RNA, 60 nt, Homo sapiens
cgcuggguccgcgcgcccugggccgggcgauguccgcuugggggagcgaggggcggggcg

SEQ ID NO: 1559 - RNA, 85 nt, Homo sapiens
ggggagguagggaaaaggaagggggaggagaaggugagaccaauguccugggugccacuccugcccagugccucccuuccucguu

SEQ ID NO: 1560 - RNA, 96 nt, Homo sapiens
gcucuggggcgugccgccgccgucgcugccaccuccccuaccgcuaguggaagaagauggcggaaggcggagcggcggaucuggacacccagcggu

SEQ ID NO: 1561 - RNA, 89 nt, Homo sapiens
agccugugggaaagagaagagcagggcagggugaaggcccggcggagacacucugcccaccccacacccugccuaugggccacacagcu

SEQ ID NO: 1562 - RNA, 109 nt, Homo sapiens
acuuucuccaucuaccaagaugagggagugggugggaggugggaaggcugccccaaauggccucuaacaucccuuccagucuccuccuccuccuccuccuucuucuucu

SEQ ID NO: 1563 - RNA, 109 nt, Homo sapiens
aagaagcuuguagauuuuucucccuuacuaucuagaauuauaggacuucaguccaugauuuggaaaaauuacuggaauuggagucaaaaauaauuugaaaauuaggaau

SEQ ID NO: 1564 - RNA, 109 nt, Homo sapiens
guuccuucuaaggauuccagugagggaguuggguguauaggaaggaaaucuuauuguccaaguuucccuuugaaaccucuuagaauggaauaaaacugcccaaaucaua

SEQ ID NO: 1565 - RNA, 109 nt, Homo sapiens
caaugaauguggaaaugcaggcaucccuucuauauacugauguaauuuuccuuggauuuauaugcaguacugagggaguggauuguaugguaguucuauuuuuacauuu

SEQ ID NO: 1566 - RNA, 109 nt, Homo sapiens
ucccgcauucccucugcuuuggucagguggugcccuccuuccauggguagagccagagaugguggguucuggcuggucagaugggaguggacagagacccgggguccuc

SEQ ID NO: 1567 - RNA, 109 nt, Homo sapiens
ugcuauugucuuacugcuacagcagggcuggggauugcaguauccgcuguugcugcugcucccaguccugccccugcugcuaccuaguccagccucaccgcaucccaga

SEQ ID NO: 1568 - RNA, 108 nt, Homo sapiens
ggaaugucaccuguguguuuucucugcaugcccucuucauuguucugcugaagacuggucucuucaugugugagggaggagguuggguauugagggaaaacagggggc

SEQ ID NO: 1569 - RNA, 109 nt, Homo sapiens
ugggccuugaugucaguagggcucaguagggaacugacccucuauuuccaccugcauaaaugaagcugaaugaggugguaggauguagagcugguugacacucugcuuu

SEQ ID NO: 1570 - RNA, 84 nt, Homo sapiens
cagcaggucagcaggaggugaggggagaggauccaccuguccuguccuguccucuccugcccuguccuggcuccagccccuccc

SEQ ID NO: 1571 - RNA, 62 nt, Homo sapiens
ucagucgggcgcaagagcacugcaguucuguugggugacagcaguguuuguuuugcccacag

SEQ ID NO: 1572 - RNA, 86 nt, Homo sapiens
ccugccugcagaaaggagcuauccacuccagguguccuuucuucugagagcuggacacuuguugggaugaccugccugcagguagg

SEQ ID NO: 1573 - RNA, 67 nt, Homo sapiens
ggaguugccagggcugccuuuggugacagcagcaguagaguugccagagcagccugcgguaacagua

SEQ ID NO: 1574 - RNA, 76 nt, Homo sapiens
cagagugggagcucuagaaagauuguugaccaaucaucuuauugacuagaccaucuuucuagaguauaacuauuuu

SEQ ID NO: 1575 - RNA, 86 nt, Homo sapiens
aaugguccccccagggaggucugcauucaaauccccagaagcugaggauuaggggacuaggaugcagaccucccugggggaccauu

SEQ ID NO: 1576 - RNA, 61 nt, Homo sapiens
gcagucuggcugugcuguaaugcagucugcacccugcugcauuacagcacagccauucucu

SEQ ID NO: 1577 - RNA, 71 nt, Homo sapiens
gcauuggaauaggggauaucucagcauguugagcccugucucuggggagcugacuucuaccucuuccaaag

SEQ ID NO: 1578 - RNA, 66 nt, Homo sapiens
gacugggaugucacugaauaugguguuugugaguugauugacaucguaucagagauuccagacaca

SEQ ID NO: 1579 - RNA, 70 nt, Homo sapiens
ggagggaagaauaggagggacuuuguauugugguucaguaccaugcaaaguccuuccuauuuuucccucc

SEQ ID NO: 1580 - RNA, 60 nt, Homo sapiens
uuccucuagaaaugcaugacccacccugaguuuuggugggccaugcauuucuagaacucc

SEQ ID NO: 1581 - RNA, 85 nt, Homo sapiens
uuuuugugugugaaauuagguaguggcaguggaacacuauauuaaucagguuuccacugccacuaccuaauuucucagauggaaa

SEQ ID NO: 1582 - RNA, 54 nt, Homo sapiens
agcagcaggggagagagaggaguccucuagacaccgacucugucuccugcagau

SEQ ID NO: 1583 - RNA, 67 nt, Homo sapiens
ccugcaggcagaaguggggcugacagggcagaggguugcgcccccucaccaucccuucugccugcag

SEQ ID NO: 1584 - RNA, 67 nt, Homo sapiens; identical to SEQ ID NO: 1583

SEQ ID NO: 1585 - RNA, 67 nt, Homo sapiens; identical to SEQ ID NO: 1583

SEQ ID NO: 1586 - RNA, 67 nt, Homo sapiens; identical to SEQ ID NO: 1583

SEQ ID NO: 1587 - RNA, 85 nt, Homo sapiens
gggacggggccugcaggcagaaguggggcugacagggcagaggguugcgcccccucaccaccccuucugccugcagcggugggcu

SEQ ID NO: 1588 - RNA, 71 nt, Homo sapiens
ggggccugcaggcagaaguggggcugacagggcagaggguugcgcccccucaccaccccuucugccugcag

SEQ ID NO: 1589 - RNA, 77 nt, Homo sapiens
uaugcucuuaccauuagaagagcuggaagaaggcugagggagaugccuucuuccagcccuucuaaugguaggagcau

SEQ ID NO: 1590 - RNA, 64 nt, Homo sapiens
gcuuugggauugacgccacaugucucagguccccagcugagucaagugucaucugucccuaggc

SEQ ID NO: 1591 - RNA, 70 nt, Homo sapiens
uauggaguggacuuucagcuggcauuuacgagucagaguucuuacagagcugccuguucuuccacuccag

SEQ ID NO: 1592 - RNA, 57 nt, Homo sapiens
cauuggaggguguggaagacaucugggccaacucugaucucuucaucuaccccccag

SEQ ID NO: 1593 - RNA, 81 nt, Homo sapiens
uggguuuugaauuugcaguaacaggugugagcauucuagcagcaguuugaugaucauguaugauacugcaaacaggaccua

SEQ ID NO: 1594 - RNA, 79 nt, Homo sapiens
ugggcugcguccacaggcacagccgguuugagcauuuuuacugaauugccaaaccagucgugccugugggcacaaccuu

SEQ ID NO: 1595 - RNA, 77 nt, Homo sapiens
gguugugcccacaggcacgacugguuuggcaauucaguaaaaaugcucaaaccggcugugccuguggacgcagccca

SEQ ID NO: 1596 - RNA, 80 nt, Homo sapiens
gagaggccaagaccuugggaauggggguaagggccuucugagcccagguccgaacucuccauuccucugcagagcgcucu

SEQ ID NO: 1597 - RNA, 73 nt, Homo sapiens
cugguguuugaggcgauguggggauguagagacaacuucccagucucauuuccucauccugccaggccaccau

SEQ ID NO: 1598 - RNA, 80 nt, Homo sapiens
agugaaucccuaguggucagagggcuuaugauauauugugagagccaugucauaagccuuuuggccacuagggauucaau

SEQ ID NO: 1599 - RNA, 87 nt, Homo sapiens
gcccuacucucaggaggaggcugaugucuucagagcaggguuuggucugugcuucucugacaucagugauucuccugcugcuuuuau

SEQ ID NO: 1600 - RNA, 98 nt, Homo sapiens
uugagcgagagauuguggcgcaccgaguucuuccagcccugguaggcgccgcggaagaaggggaagcgcgccugcaggaacugguagaucucgcugag

SEQ ID NO: 1601 - RNA, 87 nt, Homo sapiens
cccucaucucugggcaggggcuuauuguaggagucucugaagagagcuguggacugaccugcuuuaacccuuccccagguucccauu

SEQ ID NO: 1602 - RNA, 78 nt, Homo sapiens
ggccucaggcaggcgcacccgaccacaugcauggcugguggcggcgugcaggggucgggugggccaggcuguggggcg

SEQ ID NO: 1603 - RNA, 89 nt, Homo sapiens
augcaucgggauaguccgaguaacgucggggcauuccggauaggccgagaaaguguugugggaagaaaguuagauuuacgccgaugaau

SEQ ID NO: 1604 - RNA, 92 nt, Homo sapiens
cgcugcgcuucugggcccgcggcgggcguggggcugcccgggccggucgaccagcgcgccguagcucccgaggcccgagccgcgacccgcgg

SEQ ID NO: 1605 - RNA, 61 nt, Homo sapiens
gggggcgggagcuggggucugcagguucgcacugaugccugcucgcccugucucccgcuag

SEQ ID NO: 1606 - RNA, 65 nt, Homo sapiens
gggugcucggggcaggcggcugggagcggcccucacauugauggcuccugccaccuccuccgcag

SEQ ID NO: 1607 - RNA, 89 nt, Homo sapiens
cuagauugggaugguaggaccagaggggcuuacugcccuguggggcucucuggacccagugccaugcuucucugcucugcucuccccag

SEQ ID NO: 1608 - RNA, 65 nt, Homo sapiens
gagggugggcgagggcggcugagcggcuccaucccccggccugcucaucccccucgcccucucag

SEQ ID NO: 1609 - RNA, 67 nt, Homo sapiens
ccgaaagaaagguggagggguugucagagcugcggcugcuccacccugacaccccaucugcccucag

SEQ ID NO: 1610 - RNA, 72 nt, Homo sapiens
acaggugggagagcaggguauuguggaagcuccaggugccaaccaccugccucuauuccccacucuccccag

SEQ ID NO: 1611 - RNA, 60 nt, Homo sapiens
aggccuaggggguggcaggcuggccaucagugugggcuaacccuguccucucccucccag

SEQ ID NO: 1612 - RNA, 61 nt, Homo sapiens
gugcuugggaaagacaaacucagaguucccuucuugugagcucagugucuggauuuccuag

SEQ ID NO: 1613 - RNA, 68 nt, Homo sapiens
agaacuugaggggagaaugagguggagaagcccagguucugaauccccuucccucacucuucucucag

SEQ ID NO: 1614 - RNA, 73 nt, Homo sapiens
gcagccagggcagagggcacaggaaucugaggugacuggcacagaagacucaggccuguggcuccucccucag

SEQ ID NO: 1615 - RNA, 59 nt, Homo sapiens
cugagcugggugagggcaucugugguuugcuggcugccucagcuccucucuacccacag

SEQ ID NO: 1616 - RNA, 70 nt, Homo sapiens
uuggguugggguggucggcccuggaggggguuuguuugcuuauuccccucugugcuucaccccuacccag

SEQ ID NO: 1617 - RNA, 64 nt, Homo sapiens
gaaggcgagggguagaagagcacagggguucugauaaacccuucugccugcauucuacucccag

SEQ ID NO: 1618 - RNA, 75 nt, Homo sapiens
gaaugugggaaagagaaagaacaaguaaaaggaauuuucauuuuccagccccuaauuguucugucuuucucccag

SEQ ID NO: 1619 - RNA, 113 nt, Homo sapiens
gaaagaguuugggauggagagaggagaaacuugaggucucugggaguugcuuaaaccaguugaccguaaccuggccagagaauucugauagugucuucucuccucccaaacag

SEQ ID NO: 1620 - RNA, 63 nt, Homo sapiens
aaugggugggugcuggugggagccgugcccuggccacucauucggcucucucccucacccuag

SEQ ID NO: 1621 - RNA, 62 nt, Homo sapiens
gagggaguggggugggacccagcuguuggccauggcgacaacaccuggguuguccccucuag

SEQ ID NO: 1622 - RNA, 71 nt, Homo sapiens
ggguaaaggggcagggacggguggccccaggaagaagggccugguggagccgcucuucucccugcccacag

SEQ ID NO: 1623 - RNA, 66 nt, Homo sapiens
ucacguggaugacaguggaggccuccuggaucucuaggucucagggccucucuugucauccugcag

SEQ ID NO: 1624 - RNA, 127 nt, Homo sapiens
gguccuugagggcaggagcugggucuugggacugauugccccuaguggcuagcccugggucuagcagccuauggcagugucugguaaacacugguggaguccuggguggaagaaggucugguucuca

SEQ ID NO: 1625 - RNA, 63 nt, Homo sapiens
cuugcccgggagaaggagguggccuggagagcugcugucuccagccgccgccugucuccacag

SEQ ID NO: 1626 - RNA, 61 nt, Homo sapiens
uuuggagggguguggaaagaggcagaacauucguucacuuuccugccuuccucugcaccag

SEQ ID NO: 1627 - RNA, 71 nt, Homo sapiens
uggugugugggugggaaggacuggauuugaaauggucccacuccugacgauccugucccugucuccuacag

SEQ ID NO: 1628 - RNA, 69 nt, Homo sapiens
ggcccucgggccugggguugggggagcucuguccugucucacucauugcuccuccccugccuggcccag

SEQ ID NO: 1629 - RNA, 75 nt, Homo sapiens
gcugucagggaacagcugggugagcugcugccccagaggcccagcagguguccagaacucacccucugcucccag

SEQ ID NO: 1630 - RNA, 63 nt, Homo sapiens
ucuucuugggggugagguuggugucuggccccagcagcccagacugagccucucucucuccag

SEQ ID NO: 1631 - RNA, 71 nt, Homo sapiens
auggagggggguguggagccagggggcccaggucuacagcuucuccccgcucccugcccccauacucccag

SEQ ID NO: 1632 - RNA, 164 nt, Homo sapiens
caccagggcagagcagggcugaucaucucacgucagagagaggggaaggggcugcccagugagcccccacagggcucuacaucuccagcugggccuggcuggagaucccagggucccugaaggcccccgccaccguucuggucugucucugcccuggcacccag

SEQ ID NO: 1633 - RNA, 66 nt, Homo sapiens
ggcugccagggaggcugguuuggaggagucugguggccuguucucuucaccugccucugccugcag

SEQ ID NO: 1634 - RNA, 66 nt, Homo sapiens
uguuuuaggguagacacugacaacguuauguguggucuuuaaccuguugucauguuuuuucccuag

SEQ ID NO: 1635 - RNA, 63 nt, Homo sapiens
acccuaggguggggcuggagguggggcugaggcugagucuuccuccccuuccucccugcccag

SEQ ID NO: 1636 - RNA, 69 nt, Homo sapiens
gggcuuagggaugggaggccaggaugaagauuaaucccuaauccccaacacuggccuugcuauccccag

SEQ ID NO: 1637 - RNA, 63 nt, Homo sapiens
ugggcuagagaggggaaggaugugaugugagcagaugguucucacucauucuccucuguccag

SEQ ID NO: 1638 - RNA, 65 nt, Homo sapiens
uauuguugugggugggcagaagucuguuuucuucaugguuuucugaccuuugccucuccccucag

SEQ ID NO: 1639 - RNA, 68 nt, Homo sapiens
cagugcagggagaagguggaagugcagagugggcucaccucucgcccacacuguccccuucuccccag

SEQ ID NO: 1640 - RNA, 72 nt, Homo sapiens
ucugcucugagagagcucgauggcaggugccuccguguugccgaacccuccuacgcugcucucucacuccag

SEQ ID NO: 1641 - RNA, 86 nt, Homo sapiens
agagccggggccauggagcagccuguguagacggggaccugcccugcaugggcacccccucacuggcugcuucccuuggucuccag

SEQ ID NO: 1642 - RNA, 65 nt, Homo sapiens
uucuccuggggaguggcuggggagcagacagacccaaccucaugcuccccggccucugcccccag

SEQ ID NO: 1643 - RNA, 61 nt, Homo sapiens
cugacucccagggucuggucagaguugcugaguggguugaucucuggucuuuccuugacag

SEQ ID NO: 1644 - RNA, 87 nt, Homo sapiens
gugaggcggggccaggaggguguguggcgugggugcugcggggccgucagggugccugcgggacgcucaccuggcuggcccgcccag

SEQ ID NO: 1645 - RNA, 72 nt, Homo sapiens
augagcgggugggagcagaucuuauugagaguuccuucuccugcuccugauugucuucccccacccucacag

SEQ ID NO: 1646 - RNA, 66 nt, Homo sapiens
ugaaaucgcagacagggacacauggagaacgcccccaccaguucccacgugcuucucuuuccgcag

SEQ ID NO: 1647 - RNA, 72 nt, Homo sapiens
ccaggcacacaggaaaagcggggcccuggguucggcugcuaccccaaaggccacauucuccugugcacacag

SEQ ID NO: 1648 - RNA, 73 nt, Homo sapiens
aggccagguggguauggaggagcccucauauggcaguuggcgagggcccagugagccccucucugcucuccag

SEQ ID NO: 1649 - RNA, 62 nt, Homo sapiens
cuuccugguggguggggaggagaagugccguccucaugagccccucucugucccacccauag

SEQ ID NO: 1650 - RNA, 60 nt, Homo sapiens
uauccugagaaggcacagcuugcacgugaccuccugggccuggcggcugugucuucacag

SEQ ID NO: 1651 - RNA, 60 nt, Homo sapiens; identical to SEQ ID NO: 1650

SEQ ID NO: 1652 - RNA, 60 nt, Homo sapiens; identical to SEQ ID NO: 1650

SEQ ID NO: 1653 - RNA, 60 nt, Homo sapiens
ggugccucgggagggcaugggccaggccacauaaugagccaaaccccugucuacccgcag

SEQ ID NO: 1654 - RNA, 64 nt, Homo sapiens
aggccuggguguaggcuggagcugaggacugaggcucaccuugcuccugacucugugcccacag

SEQ ID NO: 1655 - RNA, 74 nt, Homo sapiens
gggaguugggcccaggaguaaacaggauuagugcuuaugcuaagaugucuucacugucacuucucugcccauag

SEQ ID NO: 1656 - RNA, 70 nt, Homo sapiens
ugugcacuugggcaggagggacccuguaugucuccccgcagcaccgucaucgugucccucuuguccacag

SEQ ID NO: 1657 - RNA, 69 nt, Homo sapiens
gaaccucggggcaugggggagggaggcuggacaggagagggcucacccaggcccuguccucugccccag

SEQ ID NO: 1658 - RNA, 59 nt, Homo sapiens
cgggcucugggugcaguggggguucccacgccgcggcaaccaccacugucucuccccag

SEQ ID NO: 1659 - RNA, 66 nt, Homo sapiens
ucaagacggggagucaggcagugguggagauggagagcccugagccuccacucuccuggcccccag

SEQ ID NO: 1660 - RNA, 73 nt, Homo sapiens
guucaagugggaggacaggaggcaggugugguuggaggaagcagccugaaccugccucccugacauuccacag

SEQ ID NO: 1661 - RNA, 64 nt, Homo sapiens
gagcucugggaggggcuggguuuggcaggacaguuuccaagcccugucuccucccaucuuccag

SEQ ID NO: 1662 - RNA, 68 nt, Homo sapiens
gacacuugggagggaagacagcuggagaguauggucacagcagcauccuccucuguuuucuuuccuag

SEQ ID NO: 1663 - RNA, 79 nt, Homo sapiens
cagccuggggaaggcuuggcagggaagacacaugagcagugccuccacuucacgccucucccuugucuccuuucccuag

SEQ ID NO: 1664 - RNA, 64 nt, Homo sapiens
aaccccgggccggaggucaagggcgucgcuucucccuaauguugccucuuuuccacggccucag

SEQ ID NO: 1665 - RNA, 69 nt, Homo sapiens
ugggguaggggugggggaauucaggggugucgaacucauggcugccaccuuuguguccccauccugcag

SEQ ID NO: 1666 - RNA, 64 nt, Homo sapiens
ccuguuaggggaaaaguccugauccgggaacccacagccccguuccugggcuucuccucuguag

SEQ ID NO: 1667 - RNA, 67 nt, Homo sapiens
uacaggccggggcuuugggugagggacccccggagucugucacggucucaccccaacucugccccag

SEQ ID NO: 1668 - RNA, 81 nt, Homo sapiens
cucccugggagggcguggaugauggugggagaggagccccacuguggaagucugacccccacaucgccccaccuuccccag

SEQ ID NO: 1669 - RNA, 113 nt, Homo sapiens
gccggguggggcggggcggccucaggaggggcccagcuccccuggaugugcugcgguggggccggaggggcgucacgugcacccaagugacgccccuucugauucugccucag

SEQ ID NO: 1670 - RNA, 61 nt, Homo sapiens
ucggcuggcggggguagagcuggcugcaggcccggccccucucagcugcugcccucuccag

SEQ ID NO: 1671 - RNA, 66 nt, Homo sapiens
gacggcugggagaagaguggugaagaagaguauugauugugcuguucgccacuucccucccugcag

SEQ ID NO: 1672 - RNA, 98 nt, Homo sapiens
cgagguaggggcgucccgggcgcgcgggcgggucccaggcugggccccucggaggccgggugcucacugccccgucccggcgcccgugucuccuccag

SEQ ID NO: 1673 - RNA, 63 nt, Homo sapiens
gugaguguggauuuggcgggguucggggguuccgacggcgaccucggcgaccccucacucacc

SEQ ID NO: 1674 - RNA, 67 nt, Homo sapiens
ccagaccccuggggcugggcaggcggaaagaggucugaacugccucugccuccuuggucuccggcag

SEQ ID NO: 1675 - RNA, 67 nt, Homo sapiens
guaagcaggggcucugggugaugugaggagcaacaggcacccuccuccacagccccugcucauuccu

SEQ ID NO: 1676 - RNA, 63 nt, Homo sapiens
gucacuguggguucuggguuggggugauacacaagccugacccuccccaaccccugcccgcag

SEQ ID NO: 1677 - RNA, 68 nt, Homo sapiens
gggcgcagggggacugggggugagcaggcccagaacccagcucgugcucacucucagucccucccuag

SEQ ID NO: 1678 - RNA, 68 nt, Homo sapiens
aggguuggggggacaggaugagaggcugucuucauucccucuugaccaccccucguuucuucccccag

SEQ ID NO: 1679 - RNA, 62 nt, Homo sapiens
uuaccuugugggguuggagagcuggcugguccagccccucagaagcucuccccuccccgcag

SEQ ID NO: 1680 - RNA, 72 nt, Homo sapiens
cagccaggagggaaggggcugagaacaggaccugugcucacuggggccugcaugacccuucccuccccacag

SEQ ID NO: 1681 - RNA, 67 nt, Homo sapiens
ggcagccagggggaugggcgagcuugggcccauuccuuuccuuacccuaccccccaucccccuguag

SEQ ID NO: 1682 - RNA, 69 nt, Homo sapiens
gaggaggggaggugugcagggcuggggucacugacucugcuuccccugcccugcaugguguccccacag

SEQ ID NO: 1683 - RNA, 82 nt, Homo sapiens
accuguaggugacagucaggggcggggugugguggggcuggggcuggcccccuccucacaccucuccuggcaucgcccccag

SEQ ID NO: 1684 - RNA, 79 nt, Homo sapiens
uggccuggucagaggcagcaggaaaugagaguuagccaggagcuuugcauacucaccccugccacucacuggcccccag

SEQ ID NO: 1685 - RNA, 65 nt, Homo sapiens
gagggcuagguggggggcuugaagccccgagaugccucacgucuucaccccucucaccuaagcag

SEQ ID NO: 1686 - RNA, 65 nt, Homo sapiens
cuccucuggggguggggggcugggcgugguggacagcgaugcaucccucgccuucucacccucag

SEQ ID NO: 1687 - RNA, 68 nt, Homo sapiens
ggaugugagggugucagcaggugacggugggggccacgcugacagccgcaccugccucucacccacag

SEQ ID NO: 1688 - RNA, 62 nt, Homo sapiens
uggccuagggggcggcuuguggaguguaugggcugagccuugcucugcucccccgcccccag

SEQ ID NO: 1689 - RNA, 64 nt, Homo sapiens
ugcucuguaggcaugaggcagggcccagguuccaugugaugcugaagcucugacauuccugcag

SEQ ID NO: 1690 - RNA, 92 nt, Homo sapiens
gugagccaguggaauggagaggcugugggcagggggagaugugaaggaaagaacuaggacccauucauccacugcauuccugcuuggcccag

SEQ ID NO: 1691 - RNA, 59 nt, Homo sapiens
ggggccaggcagggaggugggaccaugggggccuugcugugugaccaccguuccugcag

SEQ ID NO: 1692 - RNA, 116 nt, Homo sapiens
aauguuggcaaggaaagaagaggaucauguuugcccccguggacagcucucuggugugcuccuccugccauccugcccaccccugcauaaugcugcuucucuucucuccuucccag

SEQ ID NO: 1693 - RNA, 70 nt, Homo sapiens
cugggauggggacagggaucagcauggcacagauccaauaccuucuguccccugcucccuuguuccccag

SEQ ID NO: 1694 - RNA, 58 nt, Homo sapiens
uaugcaggccuguguacagcacucaggcagugccaugagccugugcuugucccugcag

SEQ ID NO: 1695 - RNA, 64 nt, Homo sapiens
ugaggauggggugagauggggaggagcagccaguccugucucaccgcucuuccccugaccccag

SEQ ID NO: 1696 - RNA, 56 nt, Homo sapiens
guaggcaggggcugggguuucagguucucagucagaaccuuggccccucuccccag

SEQ ID NO: 1697 - RNA, 70 nt, Homo sapiens
uuuccucccaagggugagaugcugccacccagcccugcagagccccugacucgcauccuucccuuggcag

SEQ ID NO: 1698 - RNA, 61 nt, Homo sapiens
cacuguagguggcgccggaggagucauuucccaucacuaauggcuucucuugcacacccag

SEQ ID NO: 1699 - RNA, 66 nt, Homo sapiens
ccgaguggggcggggcaggucccugcagggacugugacacugaaggaccugcaccuucgcccacag

SEQ ID NO: 1700 - RNA, 66 nt, Homo sapiens
aggauucugccauaggaagcuuggaguggaacugaccugcccccuuucucucugacuccauggcag

SEQ ID NO: 1701 - RNA, 65 nt, Homo sapiens
cuauuuugugugaguacagagagcaucugaauggguacaguuguugucucuuguuccucacacag

SEQ ID NO: 1702 - RNA, 61 nt, Homo sapiens
gaggguugggguggagggccaaggagcuggguggggugccaagccucuguccccaccccag

SEQ ID NO: 1703 - RNA, 62 nt, Homo sapiens
ccuucugcggcagagcuggggucaccagcccucauguacuugugacuucuccccugccacag

SEQ ID NO: 1704 - RNA, 74 nt, Homo sapiens
gugcgugguggcucgaggcgggggugggggccucgcccugcuugggcccucccugaccucuccgcuccgcacag

SEQ ID NO: 1705 - RNA, 61 nt, Homo sapiens
uggcccagggaaccaguuggggcuuccgcucugcagaggcucuaacuggcuuucccugcag

SEQ ID NO: 1706 - RNA, 61 nt, Homo sapiens
caaggucaggguugguagggguugcuguugcugugaaagcugagccucuccuucccuccag

SEQ ID NO: 1707 - RNA, 63 nt, Homo sapiens
gagguguaggggagguugggccagggaugccuucacugugucucucuggucuugccaccccag

SEQ ID NO: 1708 - RNA, 66 nt, Homo sapiens
gggcauggggagguguggagucagcauggggcuaggaggccccgcgcugacccgccuucuccgcag

SEQ ID NO: 1709 - RNA, 98 nt, Homo sapiens
cuuggucaauaggaaagaggugggaccuccuggcuuuuccucugcagcauggcucggaccuagugcaauguuuaagcuccccucucuuuccuguucag

SEQ ID NO: 1710 - RNA, 59 nt, Homo sapiens
ucuggugggagccaugagggucugugcugucucugagcaccgucucuucuguuccccag

SEQ ID NO: 1711 - RNA, 60 nt, Homo sapiens
ggcucaggaagcaagagaacccuguggucuaaccuuucccaucugcucucuuguucccag

SEQ ID NO: 1712 - RNA, 67 nt, Homo sapiens
cagcgugggcugcugagaaggggcaggguccuccagcucauuccuccugccuccuccguggccucag

SEQ ID NO: 1713 - RNA, 70 nt, Homo sapiens
gugccccaaggaaggaggcuggacaucccucaucuguuucucacuggugucuuucuucucucccuugcag

SEQ ID NO: 1714 - RNA, 81 nt, Homo sapiens
guagguagagugugaggaggaggucugagcccauguguggaccuaggucugcuguuaaacugacuaacucccacucuacag

SEQ ID NO: 1715 - RNA, 72 nt, Homo sapiens
gguggaguagagaggaaaaguuagggucaguggcagagccaggcagaugcugacccuuuuucucuuucccag

SEQ ID NO: 1716 - RNA, 61 nt, Homo sapiens
aaacgguguggaagaugggaggagaaaaaucccuguuaacuuucucucuccacuuccucag

SEQ ID NO: 1717 - RNA, 81 nt, Homo sapiens
gugagggacugggauuuguggggcgaggagggaccuguacuagccaugguucugaucacauaugucccaucccuccaucag

SEQ ID NO: 1718 - RNA, 64 nt, Homo sapiens
ugaugaggggguagaaaguggcugaagcgagauguuugucuaaaagcacuuuucugucucccag

SEQ ID NO: 1719 - RNA, 63 nt, Homo sapiens
ggcuccgcagggcccuggcgcaggcauccagacagcgggcgaaugccucccccggccccgcag

SEQ ID NO: 1720 - RNA, 64 nt, Homo sapiens
gugggaccagggccagcagggaaugucagggccaccccugaccuucacugugacucugcugcag

SEQ ID NO: 1721 - RNA, 56 nt, Homo sapiens
cagggaagcagcaguggcaagacuccuaggucacggaaguccugcuucuguugcag

SEQ ID NO: 1722 - RNA, 113 nt, Homo sapiens
uguagucuggauugaagagacgacccaagcaggcuuugugugagcagugaggcuauuuauucacuugggugcgagcucacacgaagccugcuuggguuuucucuucaauccag

SEQ ID NO: 1723 - RNA, 71 nt, Homo sapiens
ugaccacccccgggcaaagaccugcagauccccuguuagagacgggcccaggacuuugugcggggugccca

SEQ ID NO: 1724 - RNA, 72 nt, Homo sapiens
guguuuaggguacucagagcaaguugugaaacacagguguuuuuuaaccucaccuugcaucugcauccccag

SEQ ID NO: 1725 - RNA, 65 nt, Homo sapiens
agcccuggggguggucucuagccaaggcucuggggucucacccuuggcuggucucugcuccgcag

SEQ ID NO: 1726 - RNA, 151 nt, Homo sapiens
cccccauuuccucaggaauaaaagugcagcagugccugcuguggggacagcugagggcagugaggcccuggggagcugcugcaggcagcaggugggcgggacgccagcaggcugucuagcuguucccaugauggucuccuguucucugcag

SEQ ID NO: 1727 - RNA, 62 nt, Homo sapiens
gaacuuaagaauuuuguagaaaucaagcuauuugcuaaaaguucuuuguuuuuaauucacag

SEQ ID NO: 1728 - RNA, 61 nt, Homo sapiens
aacugcggggccagagcagagagcccuugcacaccaccagccucuccucccugugccccag

SEQ ID NO: 1729 - RNA, 60 nt, Homo sapiens
caggcugggggcuggaugggguagaguaggagagcccacugaccccuucugucucccuag

SEQ ID NO: 1730 - RNA, 69 nt, Homo sapiens
gacccacagaggacaguggagugugagcuggaaggagugggccuggcucaugugucuguccucuuccag

SEQ ID NO: 1731 - RNA, 70 nt, Homo sapiens
gucccugggggcugggaugggccauggugugcucugaucccccuguggucucuuggcccccaggaacucc

SEQ ID NO: 1732 - RNA, 69 nt, Homo sapiens
ccugggaguggauaggggaguguguggagagagcacugagccugcccaccagccuguguccaccuccag

SEQ ID NO: 1733 - RNA, 61 nt, Homo sapiens
gugcggaacgcuggccggggcgggaggggaagggacgcccggccggaacgccgcacucacg

SEQ ID NO: 1734 - RNA, 67 nt, Homo sapiens
cagggaggaggugguacuaggggccagcaaccugauuaccccucuuuggcccuuuguaccccuccag

SEQ ID NO: 1735 - RNA, 66 nt, Homo sapiens
ugcugcccugggguucugaggacaugcucugacuccccugauguccucuguuccucaggugcuggg

SEQ ID NO: 1736 - RNA, 74 nt, Homo sapiens
gggaaagcgugggauguccaugaagucaggugauggugauaaggucaaggccuguucauuggaacccugcgcag

SEQ ID NO: 1737 - RNA, 69 nt, Homo sapiens
aaagcaagcucagguuugagaacugcugaugucaucagucauaacuucugcguuucuccucuugagcag

SEQ ID NO: 1738 - RNA, 67 nt, Homo sapiens
gcugcuugggguuuggggugcagacauugccagaggaugggcagcagacugaccuucaaccccacag

SEQ ID NO: 1739 - RNA, 67 nt, Homo sapiens
uggaaaagagaggagcaguggugcuguggcaguggcagaggucgcuacagcccugugaucuuuccag

SEQ ID NO: 1740 - RNA, 93 nt, Homo sapiens
gcuuguuggggauugggucaggccaguguucaagggccccuccucuaguacucccuguuuguguucugccacugacugagcuucuccccacag

SEQ ID NO: 1741 - RNA, 67 nt, Homo sapiens
gugaggaggggcuggcagggaccccuccaaguuggggacggcagccagccccugcucaccccucgcc

SEQ ID NO: 1742 - RNA, 68 nt, Homo sapiens
ugugggagaggaacaugggcucaggacagcgggugucagcuugccugacccccaugucgccucuguag

SEQ ID NO: 1743 - RNA, 68 nt, Homo sapiens; identical to SEQ ID NO: 1742

SEQ ID NO: 1744 - RNA, 68 nt, Homo sapiens; identical to SEQ ID NO: 1742

SEQ ID NO: 1745 - RNA, 66 nt, Homo sapiens
guuaagcauuggggaguuuggagucgguggguggagccaaacugggcagggcuguggugagugagu

SEQ ID NO: 1746 - RNA, 64 nt, Homo sapiens
gaggcacuggguagguggggcuccagggcuccugacaccuggaccucuccuccccaggcccaca

SEQ ID NO: 1747 - RNA, 70 nt, Homo sapiens
cgaagcgggcaugcugggagagacuuugugauuugucuccaaagccucacccagcucucuggcccucuag

SEQ ID NO: 1748 - RNA, 70 nt, Homo sapiens; identical to SEQ ID NO: 1747

SEQ ID NO: 1749 - RNA, 90 nt, Homo sapiens
auuuaugaggcagcagagucuacaaguaaaucaugaauccaguugaaaauguuaaugaggccauagacguggugaaggauugagugaccu

SEQ ID NO: 1750 - RNA, 70 nt, Homo sapiens
gaaaguugaagggacaagucagauaugccauuaugugggucaugagguggugagacuucucucccuucag

SEQ ID NO: 1751 - RNA, 65 nt, Homo sapiens
auccauagguggcagaggagggacuucagaugcuucaugacacccucuuucccuaccgccuacag

SEQ ID NO: 1752 - RNA, 69 nt, Homo sapiens
ccauuuuagaggcuggaauagagauucuugaggcuuggaagaguaaggaucccuuuaucuguccucuag

SEQ ID NO: 1753 - RNA, 67 nt, Homo sapiens
cccgguguguguguagaggaagaagggaagcugggaaccugacugccucucccucuuuacccacuag

SEQ ID NO: 1754 - RNA, 58 nt, Homo sapiens
ccaggacuggcagaacacugaagcagcaggcaccugcuuccuucuguugucugugcag

SEQ ID NO: 1755 - RNA, 62 nt, Homo sapiens
gugaguaguggcgcgcggcggcucggaguaccucugccgccgcgcgcaucggcucagcaugc

SEQ ID NO: 1756 - RNA, 60 nt, Homo sapiens
caaggugggggagauggggguugaacuucauuucucaugcucauccccaucuccuuucag

SEQ ID NO: 1757 - RNA, 56 nt, Homo sapiens
cuccucaugggaguucggggugguugcuggaggucagcacccuguggcucccacag

SEQ ID NO: 1758 - RNA, 62 nt, Homo sapiens
gugggucucgcaucaggaggcaaggccaggacccgcugacccaugccuccugccgcggucag

SEQ ID NO: 1759 - RNA, 63 nt, Homo sapiens
cccagcagagggaauacagagggcaaucaggacugggucauucucucugucuuucucucucag

SEQ ID NO: 1760 - RNA, 71 nt, Homo sapiens
gccacauggagcuggaaccagaucaggcuuuaauguuugaaguaaugucaguucugcuguucugacucuag

SEQ ID NO: 1761 - RNA, 72 nt, Homo sapiens
gagucugagggacccaggacaggagaaggccuauggugauuugcauucuuccugcccuggcuccauccucag

SEQ ID NO: 1762 - RNA, 73 nt, Homo sapiens
aguugcaggaaggagacaggcaguucaggagguggcacugcugugugugagcugucuguguuuuccuucucag

SEQ ID NO: 1763 - RNA, 64 nt, Homo sapiens
aguucagggccgaaggguggaagcugcuggugcucaucucagccucugcccuuggccuccccag

SEQ ID NO: 1764 - RNA, 66 nt, Homo sapiens
augagagggagaaagcuagaagcugaagauucugaaaaucacuaacuggccucuucuuucuccuag

SEQ ID NO: 1765 - RNA, 66 nt, Homo sapiens
cagagcagggcagggaaggugggagaggggcccagcugacccuccugucacccgcuccuugcccag

SEQ ID NO: 1766 - RNA, 62 nt, Homo sapiens
gagggugguggaggaagagggcagcucccaugacugccugaccgccuucucuccucccccag

SEQ ID NO: 1767 - RNA, 76 nt, Homo sapiens
ugcacugggguaaggauaggagggucaggucugcagccuuguaucugcugauccucuuucguccuucccacuccag

SEQ ID NO: 1768 - RNA, 66 nt, Homo sapiens
ggcuuuacaagucaggagcugaagcagcuggaauucaagcccugcugccucuccucuugccugcag

SEQ ID NO: 1769 - RNA, 78 nt, Homo sapiens
cagacagggagggugugguauggauguguugaccccugaagugguucugaugaccuuucccuaucucacucuccucag

SEQ ID NO: 1770 - RNA, 78 nt, Homo sapiens
cccgcagaggcugagaaggugauguuggcucaagaaagggagauagaugguagcccaucaccuuuccgucuccccuag

SEQ ID NO: 1771 - RNA, 66 nt, Homo sapiens
ccuggaggggggcacugcgcaagcaaagccagggacccugagaggcuuugcuuccugcuccccuag

SEQ ID NO: 1772 - RNA, 61 nt, Homo sapiens
cuuggcccgcaggugagaugagggcuccuggcgcugaugcccuucucuccuccugccucag

SEQ ID NO: 1773 - RNA, 65 nt, Homo sapiens
gagaauggggggacagauggagaggacacaggcuggcacugagguccccuccacuuuccuccuag

SEQ ID NO: 1774 - RNA, 67 nt, Homo sapiens
gugggaaggagaugcucaggcagaucugucucugauuguuuccaagaucugucucgauuguuuccag

SEQ ID NO: 1775 - RNA, 59 nt, Homo sapiens
cugugucggggagucugggguccggaauucuccagagccucugugccccuacuucccag

SEQ ID NO: 1776 - RNA, 61 nt, Homo sapiens
ugggccaugggguagggcagaguagggcuggaugguagggcccacugccuaugccccacag

SEQ ID NO: 1777 - RNA, 93 nt, Homo sapiens
guaaggagggggaugaggggucauaucucuucucagggaaagcaggagcccuucagcagggucagggccccucaucuuccccuccuuucccag

SEQ ID NO: 1778 - RNA, 115 nt, Homo sapiens
guaagggaccggagaguaggaaaagcagggcucagggccagagagacugggcauagaacuaaggaggaugguguccuccugacugcaucucucuucccucucccaccccuugcag

SEQ ID NO: 1779 - RNA, 69 nt, Homo sapiens
ccgggcaggcagguguaggguggagcccacuguggcuccugacucagcccugcugccuucaccugccag

SEQ ID NO: 1780 - RNA, 57 nt, Homo sapiens
caagaaggaggauggagagcugggccagacaugcucuugccugcccucuuccuccag

SEQ ID NO: 1781 - RNA, 78 nt, Homo sapiens
cagcucagggccaggcacagaguaagcaucaauagcauuggcaaguugaacugagcugucucucgcccuuggccuuag

SEQ ID NO: 1782 - RNA, 65 nt, Homo sapiens
gcuucugggaggaggggaucuugggagugaucccaacagcugagcucccugaaucccugucccag

SEQ ID NO: 1783 - RNA, 80 nt, Homo sapiens
ugccgucggccuggggaggaggaagggcaaguccaaagguauacaguuggucuguucauucucucuuuuuggccuacaag

SEQ ID NO: 1784 - RNA, 87 nt, Homo sapiens
guguggccggcaggcgggugggcgggggcggccggugggaaccccgccccgccccgcgcccgcacucacccgcccgucuccccacag

SEQ ID NO: 1785 - RNA, 65 nt, Homo sapiens
gucuccuggggggaggagacccugcucucccuggcagcaagccucuccugcccuuccagauuagc

SEQ ID NO: 1786 - RNA, 86 nt, Homo sapiens
ggggcuggggguguggggagagagagugcacagccagcucagggauuaaagcucuuucucucucucucucucccacuucccugcag

SEQ ID NO: 1787 - RNA, 72 nt, Homo sapiens
cugggggaggaaggacaggccaucugcuauucguccaccaaccugacuugauccucucuucccuccucccag

SEQ ID NO: 1788 - RNA, 65 nt, Homo sapiens
acgggcagggcagugcacccugcaggugagagcgggaacaccugcaucacagccuuuggcccuag

SEQ ID NO: 1789 - RNA, 65 nt, Homo sapiens; identical to SEQ ID NO: 1788

SEQ ID NO: 1790 - RNA, 59 nt, Homo sapiens
cuccagggagacagugugugaggccucuugccauggccucccugcccgccucucugcag

SEQ ID NO: 1791 - RNA, 61 nt, Homo sapiens
uccgcucuguggaguggggugccuguccccugccacugggugacccaccccucuccaccag

SEQ ID NO: 1792 - RNA, 94 nt, Homo sapiens
cacgguguccccugguggaaccuggcagggggagagguaaggucuuucagccucuccaaagcccauggucagguacucaggugggggagcccug

SEQ ID NO: 1793 - RNA, 60 nt, Homo sapiens
gauccaucucugccuguauuggcuuggauucugcaaagccuacaggcuggaaugggcuca

SEQ ID NO: 1794 - RNA, 54 nt, Homo sapiens
uuuccuguccuccaaccagaccaugccacauccgucugguccuggacaggaggc

SEQ ID NO: 1795 - RNA, 57 nt, Homo sapiens
ugagaacugacaaaugugguagguggucgaagucauccacaccauggacgguuuacc

SEQ ID NO: 1796 - RNA, 73 nt, Homo sapiens
uucaugaacugggucuagcuuggagccuugguagggaagcaagcugaggagauaggaggacaaguugugggau

SEQ ID NO: 1797 - RNA, 56 nt, Homo sapiens
ucuggggucuugggccaucugguugugacaucacugauggcccaagaccucagacc

SEQ ID NO: 1798 - RNA, 60 nt, Homo sapiens
uuguucucaaacuggcugucagagugugcauggcaggcugcagccacuuggggaacuggu

SEQ ID NO: 1799 - RNA, 60 nt, Homo sapiens
ucagcauucauuggcaccagagaugaaauugggacuccucugugcuacuggaugaagagu

SEQ ID NO: 1800 - RNA, 71 nt, Homo sapiens
ggcucaaucucugguccugcagccuucugccuuuggcuuucugaagcgagcugaacuagagauugggccca

SEQ ID NO: 1801 - RNA, 66 nt, Homo sapiens
uucaacaaggguguaggauggccagggaaguaugccgggccuuggcauuucuauguuaguuggaag

SEQ ID NO: 1802 - RNA, 52 nt, Homo sapiens
ugcugagguccgggcugugccccguaccggacagggcccuggcuuuagcaga

SEQ ID NO: 1803 - RNA, 84 nt, Homo sapiens
uaaagacuguagaggcaacugguguucucacgcaaaguggccagggugugggagacuagaucuuugacucuggcagucuccagg

SEQ ID NO: 1804 - RNA, 69 nt, Homo sapiens
ugcuuccuuucucagcugaaccccugccccuggagcccccagcagggcccucugagguggaacagcagc

SEQ ID NO: 1805 - RNA, 67 nt, Homo sapiens
cuuuuaucauuucauuuaugccuguuagcaugaaaaaagaggcugagaagggaagauggugacaagg

SEQ ID NO: 1806 - RNA, 61 nt, Homo sapiens
ucucguuugaucucggaagcuaagcaggguugggccugguuaguacuuggaugggaaacuu

SEQ ID NO: 1807 - RNA, 53 nt, Homo sapiens
guuugaucucggaagcuaagcagggucgggccugguuaguacuuggaugggag

SEQ ID NO: 1808 - RNA, 59 nt, Homo sapiens
cuuagacugccagacucccugaggacaugcaguuucagggagucugguagucuaagugu

SEQ ID NO: 1809 - RNA, 77 nt, Homo sapiens
uuaggggagguggaugagugggggcaggcaggggauuggcuaagaaccugacucuugcacucuggccuucucccagg

SEQ ID NO: 1810 - RNA, 59 nt, Homo sapiens
cggggucggcggcgacgugcucagcuuggcacccaaguucugccgcuccgacgcccggc

SEQ ID NO: 1811 - RNA, 57 nt, Homo sapiens
aauagcucagaaugucaguucuguuuuaaguaacagaauugauaacugagcaaggaa

SEQ ID NO: 1812 - RNA, 67 nt, Homo sapiens
uggagcugugugcagggccagcgcggagcccgagcagccgcggugaagcgccugugcucugccgaga

SEQ ID NO: 1813 - RNA, 79 nt, Homo sapiens
guagacaggaugagggcagagccagcuuccugaucugauggaagucaugaagccuucucugccuuacgcuuggcucugc

SEQ ID NO: 1814 - RNA, 122 nt, Homo sapiens
ugauugugcggacucguguguaagaaaaacuaggacugugugguguaaauaacuacaauucucuuaacuccguagcaguugccaacucaguccuuguacuucguuaacacgaaucuguuuca

SEQ ID NO: 1815 - RNA, 99 nt, Homo sapiens
gcaagggacagggagggucguggcgacacucgcgccagcucccgggacggcugggcucgggcuggucgccgaccuccgacccuccacuagaugccuggc

SEQ ID NO: 1816 - RNA, 96 nt, Homo sapiens
gccccgccgccuggccucuggcccgcuggggcgcgggcuuucgcuuucagucgagggcuagcgagcgcagcggagccuggagagaaggcgcugggc

SEQ ID NO: 1817 - RNA, 103 nt, Homo sapiens
gugucggcuguggcgugacugucccucugugucccccacuaggcccacugcucaguggagcguggaggacgaggaggaggccguccacgagcaaugccagcau

SEQ ID NO: 1818 - RNA, 101 nt, Homo sapiens
gcuggggcuggguggguguggcaggcccaccuuggguaugcaaagcucugacaguguuucacuugcuacccucggucugcuuaccacacucccaguucugc

SEQ ID NO: 1819 - RNA, 106 nt, Homo sapiens
gacuuuauauuguugaacaucagacucaaggccaacaacugacuacuucgaaaaugggaaguagacaauuguugaucuugggccugauguucaacaauauaaaguu

SEQ ID NO: 1820 - RNA, 79 nt, Homo sapiens
ggucagaaguuuggacauaguguggcuggguccucugugcagggucuuacccagccacacuacauccaaacuucugacc

SEQ ID NO: 1821 - RNA, 160 nt, Homo sapiens
uggcucacugcagccuccccgcccccucaggugauccucccaccucauccucccaaguagcugggaauacaggugugugccaccaugccucuacaagcuaccugggagacugagguuggaagauugcuugagccuaggaggucgaggcgacagugagcca

SEQ ID NO: 1822 - RNA, 82 nt, Homo sapiens
uaaaugccuuugacuacuacauacauaugccuacuacuacuuucauauguaggcauauguauguaguagucaaaggcauuua

SEQ ID NO: 1823 - RNA, 132 nt, Homo sapiens
ucucacacuucaauaggcauugucuggggucuuauucaaaugcagauccugacuucacuggugcaguaagaagucagagaaucugcaucuguaacaagcucccaggugaugauggugcugcuggugugcaga

SEQ ID NO: 1824 - RNA, 65 nt, Homo sapiens
uuccuuccaucuccaucaccuugagcaucuucugggcagcugaggugaccgcagaugggaaggaa

SEQ ID NO: 1825 - RNA, 61 nt, Homo sapiens
gcuuggugaggaccccaagcucggcacuauugugacugugcuuuuggcuuccuuuccaggc

SEQ ID NO: 1826 - RNA, 56 nt, Homo sapiens
uguuuuaaggacacugagggauccuuuguucuggaucccucaguguccuuaaaaca

SEQ ID NO: 1827 - RNA, 76 nt, Homo sapiens
ugugacccuagaauaauuacccaacgucucugagucucgguuuugagagggugaguaauuauucuagggucacaca

SEQ ID NO: 1828 - RNA, 76 nt, Homo sapiens
ugugacccuagaauaauuacucacccucucaaaaccgagacucagagacguuggguaauuauucuagggucacaca

SEQ ID NO: 1829 - RNA, 79 nt, Homo sapiens
gcucggcccccacagcgaaacggccgccuaaaccacccaggccuuauggcuucauaggcugugaugcucuccugagccc

SEQ ID NO: 1830 - RNA, 68 nt, Homo sapiens
gugcaaagagcaggaggacaggggauuuaucucccaagggagguccccugauccuagucacggcacca

SEQ ID NO: 1831 - RNA, 66 nt, Homo sapiens
ugcccugagacuuuugcucuaauaauuuauucuaauaauaauuuagaucaaaagccucagggcaga

SEQ ID NO: 1832 - RNA, 49 nt, Homo sapiens
uucccagccaacgcaccaaaaaugauaugggucuguugucuggagaaac

SEQ ID NO: 1833 - RNA, 59 nt, Homo sapiens
ucugguguauagcguugcucaaguccucuauuucuuugaacaacaguauacaccaaaua

SEQ ID NO: 1834 - RNA, 69 nt, Homo sapiens
uggagggcugcgggacuguagagggcaugagcucaggagcucaggccagcucauggugcaaggccucug

SEQ ID NO: 1835 - RNA, 75 nt, Homo sapiens
gcuuuuccacuggcgauuuuggaacucaauggcagaaaugucaagaagaguuuuauccuuugccgaaagagaaaa

SEQ ID NO: 1836 - RNA, 86 nt, Homo sapiens
cagcaaugcagaaaguacagaucggauggguucaauagauugcuuuagcugaagcaagccuucccauuguacauaucucauugucu

SEQ ID NO: 1837 - RNA, 97 nt, Homo sapiens
uuacggucacacugugcucacuuugucaaauaaaagauggagucguuugacgucuuuuaacacccuuugagcacaugagcagacggagugaucauga

SEQ ID NO: 1838 - RNA, 82 nt, Homo sapiens
cuucucugagcauccagccucuaggagcugugccuccuggccuauuccuguucguggauugucuggaugcauccuugagacu

SEQ ID NO: 1839 - RNA, 69 nt, Homo sapiens
aauuugggauguggcucuguaguaagauggacuugcgguucaaucccagcucagggccuuuuuaaauua

SEQ ID NO: 1840 - RNA, 89 nt, Homo sapiens
uggucacugccagugcugagacauuaaagauccaggccccacggagaaccagggcaccuggacuuugaucuugccauaaugguaugccu

SEQ ID NO: 1841 - RNA, 81 nt, Homo sapiens
uacaggugcaggggaacuguagaugaaaaggcuuggcacuugagggaaagccucaguucauucucauuuugcucaccuguu

SEQ ID NO: 1842 - RNA, 76 nt, Homo sapiens
uuuaaauccuguuuuucccacuuacuauucuggucagauaucccaugaagcaguggguaggaggacaggaaaaagc

SEQ ID NO: 1843 - RNA, 75 nt, Homo sapiens
gagaggaugccuuagauuagaggauauuguucagugggauuuggagaggacgccuuagauuagagguauuguuca

SEQ ID NO: 1844 - RNA, 85 nt, Homo sapiens
cuuaugcaugcagugauuugaggauuauugcucacgguaagaaaaacaugaguaauauauugucuucaaagaaccuaugcucuaa

SEQ ID NO: 1845 - RNA, 81 nt, Homo sapiens
uagaggcaguuucaacagauguguagacuuuugauaugagaaauugguuucaaaaucaggagucggggcuuuacugcuuuu

SEQ ID NO: 1846 - RNA, 90 nt, Homo sapiens
agauggagugagcacacugagcgagcggacauccuuccauaguaaauaagcggugccgcgcgcuccgcuggcucccaaacacuccagucc

SEQ ID NO: 1847 - RNA, 100 nt, Homo sapiens
caguacaugagagccaucauuuuuguuguuguuguauuuuucagcaaggcaagggcuuugaugucuuguaggaacaguugaauuuuggcuucauguaauu

SEQ ID NO: 1848 - RNA, 78 nt, Homo sapiens
caucuugcuuacauuccuguggaacauauuguugccucugcauguuacaaugugaucuuuuggauguagggcaaaucu

SEQ ID NO: 1849 - RNA, 77 nt, Homo sapiens
uucuguguuuccuagaaacuguaaacuuagucauaaagaugauccugagugcacagucuuucuugagacuuucagcc

SEQ ID NO: 1850 - RNA, 68 nt, Homo sapiens
ggcuaacucauguuuguuguaaggaucguuguggcaauacaguuauccuuacaacaaauacuuugcca

SEQ ID NO: 1851 - RNA, 86 nt, Homo sapiens
cgccugagcgugcagcaggacaucuuccugaccugguaauaauuaggugagaaggaugguugggggcggucggcguaacucaggga

SEQ ID NO: 1852 - RNA, 88 nt, Homo sapiens
acuugaucccaugugauugacggcugacuccaugugagugaagccugaucaucaugugagugaagccugaucaucaugugagugaagc

SEQ ID NO: 1853 - RNA, 65 nt, Homo sapiens
cggccacauggcccaggcucuucuccgagugaucucgguggacuggagugggugguagguggcag

SEQ ID NO: 1854 - RNA, 65 nt, Homo sapiens; identical to SEQ ID NO: 1853

SEQ ID NO: 1855 - RNA, 80 nt, Homo sapiens
gcgucaagauggcggcggggagguaggcagagcaggacgccgcugcugccgccgccaccgccgccuccgcuccagucgcc

SEQ ID NO: 1856 - RNA, 72 nt, Homo sapiens
gauuucagugaccuggcagcagggagcgucgucaguguuugacuguuuaugguaugucagggagcugguucc

SEQ ID NO: 1857 - RNA, 81 nt, Homo sapiens
ccaguuccugaguuuaugcaagaugcccaugggagcccagagacguccuauggcgagacuggcauguacucacacaacuga

SEQ ID NO: 1858 - RNA, 80 nt, Homo sapiens
ccuugcugauggcagaugucggaucugccucgcuuauacgugcccuugcugauggcagaugucgggucugccucgcuuau

SEQ ID NO: 1859 - RNA, 83 nt, Homo sapiens
ccuauccacacgucuggucuagaguucuccugugagagcuacuaagucuuauauggacuuuucugauacaauguaguggaaag

SEQ ID NO: 1860 - RNA, 75 nt, Homo sapiens
guggggcagggggugggaugggcacugggaguccaaaggaaagggcugagugggguucugacuccucugcccaac

SEQ ID NO: 1861 - RNA, 84 nt, Homo sapiens
uccgccccgcccccuccaccgggcugaccggccugggauuccugccuucuaggucuaggcccggugagagacuccacacagcgg

SEQ ID NO: 1862 - RNA, 72 nt, Homo sapiens
ugccuggguucagugaucgucucugcuggcuguagggcagcagucagaggggacaucacaggccuccagagg

SEQ ID NO: 1863 - RNA, 89 nt, Homo sapiens
auggcucuaagaaggacacuggugucaacggcugagcccuuugauaagggggagguuuggaagacacuuauguccuggauugggaaaug

SEQ ID NO: 1864 - RNA, 95 nt, Homo sapiens
uuauugucuuuauuuucugagucuugccucuauggccccccuccucucugaaagcaaggccacuugagucgugccuuucugaaugaagucaaugu

SEQ ID NO: 1865 - RNA, 81 nt, Homo sapiens
gccugugugaugauggagcugggaauacucuggggagagaguccucuuuucagcuguauuuugcuuccuucccacacagac

SEQ ID NO: 1866 - RNA, 89 nt, Homo sapiens
cgagggggugcaggacuugacggcugcaacugugcggccggccacaccgucacaccgggugcagcgucugucauucuguacccucaucu

SEQ ID NO: 1867 - RNA, 89 nt, Homo sapiens
cagauaaauagaauacuaaguaaaaaaucaguauggauuaaauuuauauuuuccucgauacugaguauuuuuucuuagguuuaguuugg

SEQ ID NO: 1868 - RNA, 65 nt, Homo sapiens
cuaggagggaugggagagaggacugugaggcauggguggcucuauggucacgcccaucuuccuac

SEQ ID NO: 1869 - RNA, 93 nt, Homo sapiens
uccacuagucugcuagucuggacugauaugguuagcuuuuuuuuuuuuuugagauggagucuggcucuguugcccaggcuggaguacaguggc

SEQ ID NO: 1870 - RNA, 78 nt, Homo sapiens
ucuaagaagugaagacuucuuggauuacaggggcccuacuuuaagggcccuuucaguuggaaguuuuccuuucugccu

SEQ ID NO: 1871 - RNA, 86 nt, Homo sapiens
gggaggagggccucgguacuggaaagggguauggauucuguuguuuuggcaacauucuucuuaucggcacugggucacucagcuca

SEQ ID NO: 1872 - RNA, 82 nt, Homo sapiens
aaggagcacucacuccaauuucccuggacugggggcaggcugccaccuccuggggacaggggauuggggcaggauguuccag

SEQ ID NO: 1873 - RNA, 22 nt, Homo sapiens
ugagguaguagguuguauaguu

SEQ ID NO: 1874 - RNA, 22 nt, Homo sapiens
ugagguaguagguugugugguu

SEQ ID NO: 1875 - RNA, 22 nt, Homo sapiens
ugagguaguagguuguaugguu

SEQ ID NO: 1876 - RNA, 22 nt, Homo sapiens
agagguaguagguugcauaguu

SEQ ID NO: 1877 - RNA, 22 nt, Homo sapiens
ugagguaggagguuguauaguu

SEQ ID NO: 1878 - RNA, 22 nt, Homo sapiens
ugagguaguagauuguauaguu

SEQ ID NO: 1879 - RNA, 22 nt, Homo sapiens
ugagguaguaguuuguacaguu

SEQ ID NO: 1880 - RNA, 22 nt, Homo sapiens
ugagguaguaguuugugcuguu

SEQ ID NO: 1881 - RNA, 22 nt, Homo sapiens
aacccguagauccgaacuugug

SEQ ID NO: 1882 - RNA, 22 nt, Homo sapiens
caguuaucacagugcugaugcu

SEQ ID NO: 1883 - RNA, 23 nt, Homo sapiens
agcuucuuuacagugcugccuug

SEQ ID NO: 1884 - RNA, 23 nt, Homo sapiens
ucaaaugcucagacuccuguggu

SEQ ID NO: 1885 - RNA, 23 nt, Homo sapiens
aaaagugcuuacagugcagguag

SEQ ID NO: 1886 - RNA, 21 nt, Homo sapiens
uaaagugcugacagugcagau

SEQ ID NO: 1887 - RNA, 23 nt, Homo sapiens
uacccuguagauccgaauuugug

SEQ ID NO: 1888 - RNA, 23 nt, Homo sapiens
uacccuguagaaccgaauuugug

SEQ ID NO: 1889 - RNA, 18 nt, Homo sapiens
cagggucagcugagcaug

SEQ ID NO: 1890 - RNA, 21 nt, Homo sapiens
ggacccacccggccgggaaua

SEQ ID NO: 1891 - RNA, 21 nt, Homo sapiens
agaggauacccuuuguauguu

SEQ ID NO: 1892 - RNA, 20 nt, Homo sapiens
ccugagcccgggccgcgcag

SEQ ID NO: 1893 - RNA, 21 nt, Homo sapiens
uggcagggaggcugggagggg

SEQ ID NO: 1894 - RNA, 19 nt, Homo sapiens
gugaggacucgggaggugg

SEQ ID NO: 1895 - RNA, 22 nt, Homo sapiens
guggguacggcccagugggggg

SEQ ID NO: 1896 - RNA, 22 nt, Homo sapiens
uggagugugacaaugguguuug

SEQ ID NO: 1897 - RNA, 26 nt, Homo sapiens
gugagggcaugcaggccuggaugggg

SEQ ID NO: 1898 - RNA, 17 nt, Homo sapiens
guggggccaggcggugg

SEQ ID NO: 1899 - RNA, 21 nt, Homo sapiens
gugggcgggggcaggugugug

SEQ ID NO: 1900 - RNA, 24 nt, Homo sapiens
guggguaggguuugggggagagcg

SEQ ID NO: 1901 - RNA, 22 nt, Homo sapiens
agugggaggccagggcacggca

SEQ ID NO: 1902 - RNA, 22 nt, Homo sapiens
ugagugacaggggaaaugggga

SEQ ID NO: 1903 - RNA, 21 nt, Homo sapiens
cgggggcggggccgaagcgcg

SEQ ID NO: 1904 - RNA, 23 nt, Homo sapiens
gugagugggagccccagugugug

SEQ ID NO: 1905 - RNA, 21 nt, Homo sapiens
uaggccuuuagaucacuuaaa

SEQ ID NO: 1906 - RNA, 22 nt, Homo sapiens
cguguucacagcggaccuugau

SEQ ID NO: 1907 - RNA, 22 nt, Homo sapiens
acccgucccguucguccccgga

SEQ ID NO: 1908 - RNA, 21 nt, Homo sapiens
acggugcuggauguggccuuu

SEQ ID NO: 1909 - RNA, 21 nt, Homo sapiens
acucuagcugccaaaggcgcu

SEQ ID NO: 1910 - RNA, 22 nt, Homo sapiens
agaaggaaauugaauucauuua

SEQ ID NO: 1911 - RNA, 22 nt, Homo sapiens
cggaugagcaaagaaagugguu

SEQ ID NO: 1912 - RNA, 24 nt, Homo sapiens
ucccugagacccuuuaaccuguga

SEQ ID NO: 1913 - RNA, 22 nt, Homo sapiens
ucccugagacccuaacuuguga

SEQ ID NO: 1914 - RNA, 21 nt, Homo sapiens
cauuauuacuuuugguacgcg

SEQ ID NO: 1915 - RNA, 23 nt, Homo sapiens
ccucagggcuguagaacagggcu

SEQ ID NO: 1916 - RNA, 22 nt, Homo sapiens
cuuggcaccuagcaagcacuca

SEQ ID NO: 1917 - RNA, 22 nt, Homo sapiens
ggugguugaggcugcaguaagu

SEQ ID NO: 1918 - RNA, 21 nt, Homo sapiens
cugggaggucaaggcugcagu

SEQ ID NO: 1919 - RNA, 22 nt, Homo sapiens
cugaagcucagagggcucugau

SEQ ID NO: 1920 - RNA, 24 nt, Homo sapiens
aaauauauauauauauguacguau

SEQ ID NO: 1921 - RNA, 23 nt, Homo sapiens
cggggccguagcacugucugaga

SEQ ID NO: 1922 - RNA, 23 nt, Homo sapiens
gggggccgauacacuguacgaga

SEQ ID NO: 1923 - RNA, 21 nt, Homo sapiens
gaucucacuuuguugcccagg

SEQ ID NO: 1924 - RNA, 22 nt, Homo sapiens
ugcuggaucagugguucgaguc

SEQ ID NO: 1925 - RNA, 23 nt, Homo sapiens
gcagaucaggacuguaacucacc

SEQ ID NO: 1926 - RNA, 25 nt, Homo sapiens
ugggaacggguuccggcagacgcug

SEQ ID NO: 1927 - RNA, 21 nt, Homo sapiens
cacccagaucugcggccuaau

SEQ ID NO: 1928 - RNA, 21 nt, Homo sapiens
cuuuuugcggucugggcuugc

SEQ ID NO: 1929 - RNA, 22 nt, Homo sapiens
uuagggcccuggcuccaucucc

SEQ ID NO: 1930 - RNA, 22 nt, Homo sapiens
uucauucggcuguccagaugua

SEQ ID NO: 1931 - RNA, 19 nt, Homo sapiens
cgcucuaggcaccgcagca

SEQ ID NO: 1932 - RNA, 22 nt, Homo sapiens
uuugaggcuacagugagaugug

SEQ ID NO: 1933 - RNA, 22 nt, Homo sapiens
ccaccuccccugcaaacgucca

SEQ ID NO: 1934 - RNA, 21 nt, Homo sapiens
ucgaccggaccucgaccggcu

SEQ ID NO: 1935 - RNA, 22 nt, Homo sapiens
uucacauugugcuacugucugc

SEQ ID NO: 1936 - RNA, 21 nt, Homo sapiens
acucuuucccuguugcacuac

SEQ ID NO: 1937 - RNA, 22 nt, Homo sapiens
accguggcuuucgauuguuacu

SEQ ID NO: 1938 - RNA, 22 nt, Homo sapiens
agcugguaaaauggaaccaaau

SEQ ID NO: 1939 - RNA, 22 nt, Homo sapiens
uggggagcggcccccggguggg

SEQ ID NO: 1940 - RNA, 22 nt, Homo sapiens
ugugacugguugaccagagggg

SEQ ID NO: 1941 - RNA, 23 nt, Homo sapiens
uauggcuuuuuauuccuauguga

SEQ ID NO: 1942 - RNA, 23 nt, Homo sapiens
uauggcuuuucauuccuauguga

SEQ ID NO: 1943 - RNA, 23 nt, Homo sapiens
acuccauuuguuuugaugaugga

SEQ ID NO: 1944 - RNA, 23 nt, Homo sapiens
agcugguguugugaaucaggccg

SEQ ID NO: 1945 - RNA, 23 nt, Homo sapiens
ucuacagugcacgugucuccagu

SEQ ID NO: 1946 - RNA, 22 nt, Homo sapiens
cagugguuuuacccuaugguag

SEQ ID NO: 1947 - RNA, 22 nt, Homo sapiens
caucuuccaguacaguguugga

SEQ ID NO: 1948 - RNA, 21 nt, Homo sapiens
cauaaaguagaaagcacuacu

SEQ ID NO: 1949 - RNA, 22 nt, Homo sapiens
ggugcagugcugcaucucuggu

SEQ ID NO: 1950 - RNA, 22 nt, Homo sapiens
ggauaucaucauauacuguaag

SEQ ID NO: 1951 - RNA, 23 nt, Homo sapiens
guccaguuuucccaggaaucccu

SEQ ID NO: 1952 - RNA, 21 nt, Homo sapiens
cuccguuugccuguuucgcug

SEQ ID NO: 1953 - RNA, 22 nt, Homo sapiens
ugagaacugaauuccauggguu

SEQ ID NO: 1954 - RNA, 22 nt, Homo sapiens
ugagaacugaauuccauaggcu

SEQ ID NO: 1955 - RNA, 22 nt, Homo sapiens
aaaguucugagacacuccgacu

SEQ ID NO: 1956 - RNA, 22 nt, Homo sapiens
aaguucuguuauacacucaggc

SEQ ID NO: 1957 - RNA, 23 nt, Homo sapiens
ucuggcuccgugucuucacuccc

SEQ ID NO: 1958 - RNA, 22 nt, Homo sapiens
ucucccaacccuuguaccagug

SEQ ID NO: 1959 - RNA, 21 nt, Homo sapiens
ucgaggagcucacagucuagu

SEQ ID NO: 1960 - RNA, 23 nt, Homo sapiens
agguucugugauacacuccgacu

SEQ ID NO: 1961 - RNA, 22 nt, Homo sapiens
ucauuuuugugauguugcagcu

SEQ ID NO: 1962 - RNA, 22 nt, Homo sapiens
agcuguaauuagucaguuuucu

SEQ ID NO: 1963 - RNA, 22 nt, Homo sapiens
uagguuauccguguugccuucg

SEQ ID NO: 1964 - RNA, 23 nt, Homo sapiens
uuaaugcuaaucgugauaggggu

SEQ ID NO: 1965 - RNA, 22 nt, Homo sapiens
uagcagcacauaaugguuugug

SEQ ID NO: 1966 - RNA, 22 nt, Homo sapiens
uagcagcacaucaugguuuaca

SEQ ID NO: 1967 - RNA, 22 nt, Homo sapiens
uagcagcacguaaauauuggcg

SEQ ID NO: 1968 - RNA, 23 nt, Homo sapiens
caaagugcuuacagugcagguag

SEQ ID NO: 1969 - RNA, 23 nt, Homo sapiens
aacauucaacgcugucggugagu

SEQ ID NO: 1970 - RNA, 23 nt, Homo sapiens
aacauucauugcugucggugggu

SEQ ID NO: 1971 - RNA, 22 nt, Homo sapiens
aacauucaaccugucggugagu

SEQ ID NO: 1972 - RNA, 23 nt, Homo sapiens
aacauucauuguugucggugggu

SEQ ID NO: 1973 - RNA, 24 nt, Homo sapiens
uuuggcaaugguagaacucacacu

SEQ ID NO: 1974 - RNA, 22 nt, Homo sapiens
uauggcacugguagaauucacu

SEQ ID NO: 1975 - RNA, 22 nt, Homo sapiens
uggagagaaaggcaguuccuga

SEQ ID NO: 1976 - RNA, 22 nt, Homo sapiens
caaagaauucuccuuuugggcu

SEQ ID NO: 1977 - RNA, 22 nt, Homo sapiens
ggcuacaacacaggacccgggc

SEQ ID NO: 1978 - RNA, 21 nt, Homo sapiens
caucccuugcaugguggaggg

SEQ ID NO: 1979 - RNA, 23 nt, Homo sapiens
uaaggugcaucuagugcagauag

SEQ ID NO: 1980 - RNA, 23 nt, Homo sapiens
uaaggugcaucuagugcaguuag

SEQ ID NO: 1981 - RNA, 21 nt, Homo sapiens
cggcggggacggcgauugguc

SEQ ID NO: 1982 - RNA, 21 nt, Homo sapiens
ugagugccggugccugcccug

SEQ ID NO: 1983 - RNA, 22 nt, Homo sapiens
ugauauguuugauauauuaggu

SEQ ID NO: 1984 - RNA, 21 nt, Homo sapiens
ccaguccugugccugccgccu

SEQ ID NO: 1985 - RNA, 23 nt, Homo sapiens
ugaguaccgccaugucuguuggg

SEQ ID NO: 1986 - RNA, 22 nt, Homo sapiens
cccugugcccggcccacuucug

SEQ ID NO: 1987 - RNA, 22 nt, Homo sapiens
accuugccuugcugcccgggcc

SEQ ID NO: 1988 - RNA, 23 nt, Homo sapiens
caacggaaucccaaaagcagcug

SEQ ID NO: 1989 - RNA, 21 nt, Homo sapiens
cugaccuaugaauugacagcc

SEQ ID NO: 1990 - RNA, 22 nt, Homo sapiens
ugggucuuugcgggcgagauga

SEQ ID NO: 1991 - RNA, 22 nt, Homo sapiens
cgggguuuugagggcgagauga

SEQ ID NO: 1992 - RNA, 22 nt, Homo sapiens
uguaacagcaacuccaugugga

SEQ ID NO: 1993 - RNA, 21 nt, Homo sapiens
uagcagcacagaaauauuggc

SEQ ID NO: 1994 - RNA, 22 nt, Homo sapiens
uagguaguuucauguuguuggg

SEQ ID NO: 1995 - RNA, 22 nt, Homo sapiens
uagguaguuuccuguuguuggg

SEQ ID NO: 1996 - RNA, 23 nt, Homo sapiens
cggguagagagggcagugggagg

SEQ ID NO: 1997 - RNA, 23 nt, Homo sapiens
cccaguguucagacuaccuguuc

SEQ ID NO: 1998 - RNA, 23 nt, Homo sapiens
cccaguguuuagacuaucuguuc

SEQ ID NO: 1999 - RNA, 22 nt, Homo sapiens
aguuuugcauaguugcacuaca

SEQ ID NO: 2000 - RNA, 23 nt, Homo sapiens
aguuuugcagguuugcauccagc

SEQ ID NO: 2001 - RNA, 22 nt, Homo sapiens
aguuuugcagguuugcauuuca

SEQ ID NO: 2002 - RNA, 22 nt, Homo sapiens
caucuuaccggacagugcugga

SEQ ID NO: 2003 - RNA, 22 nt, Homo sapiens
caucuuacugggcagcauugga

SEQ ID NO: 2004 - RNA, 22 nt, Homo sapiens
cgucuuacccagcaguguuugg

SEQ ID NO: 2005 - RNA, 22 nt, Homo sapiens
uuccuaugcauauacuucuuug

SEQ ID NO: 2006 - RNA, 22 nt, Homo sapiens
uagugguccuaaacauuucaca

SEQ ID NO: 2007 - RNA, 22 nt, Homo sapiens
uucccuuugucauccuaugccu

SEQ ID NO: 2008 - RNA, 22 nt, Homo sapiens
uccuucauuccaccggagucug

SEQ ID NO: 2009 - RNA, 22 nt, Homo sapiens
gagcuuuuggcccggguuauac

SEQ ID NO: 2010 - RNA, 22 nt, Homo sapiens
aagcuuuuugcucgaauuaugu

SEQ ID NO: 2011 - RNA, 23 nt, Homo sapiens
uaaagugcuuauagugcagguag

SEQ ID NO: 2012 - RNA, 23 nt, Homo sapiens
caaagugcucauagugcagguag

SEQ ID NO: 2013 - RNA, 22 nt, Homo sapiens
agccccugcccaccgcacacug

SEQ ID NO: 2014 - RNA, 22 nt, Homo sapiens
uagucccuuccuugaagcgguc

SEQ ID NO: 2015 - RNA, 22 nt, Homo sapiens
agcuuccaugacuccugaugga

SEQ ID NO: 2016 - RNA, 22 nt, Homo sapiens
uucccuuugucauccuucgccu

SEQ ID NO: 2017 - RNA, 21 nt, Homo sapiens
gguucuuagcauaggaggucu

SEQ ID NO: 2018 - RNA, 23 nt, Homo sapiens
accuuggcucuagacugcuuacu

SEQ ID NO: 2019 - RNA, 22 nt, Homo sapiens
ugccugucuacacuugcugugc

SEQ ID NO: 2020 - RNA, 21 nt, Homo sapiens
augaccuaugaauugacagac

SEQ ID NO: 2021 - RNA, 22 nt, Homo sapiens
uagcuuaucagacugauguuga

SEQ ID NO: 2022 - RNA, 22 nt, Homo sapiens
uaaucucagcuggcaacuguga

SEQ ID NO: 2023 - RNA, 22 nt, Homo sapiens
aaaucucugcaggcaaauguga

SEQ ID NO: 2024 - RNA, 21 nt, Homo sapiens
uugugcuugaucuaaccaugu

SEQ ID NO: 2025 - RNA, 21 nt, Homo sapiens
ugauuguccaaacgcaauucu

SEQ ID NO: 2026 - RNA, 22 nt, Homo sapiens
agauguccagccacaauucucg

SEQ ID NO: 2027 - RNA, 22 nt, Homo sapiens
accuggcauacaauguagauuu

SEQ ID NO: 2028 - RNA, 22 nt, Homo sapiens
cucaguagccaguguagauccu

SEQ ID NO: 2029 - RNA, 22 nt, Homo sapiens
cguguauuugacaagcugaguu

SEQ ID NO: 2030 - RNA, 21 nt, Homo sapiens
caagucacuagugguuccguu

SEQ ID NO: 2031 - RNA, 22 nt, Homo sapiens
aguucuucaguggcaagcuuua

SEQ ID NO: 2032 - RNA, 22 nt, Homo sapiens
gcccucugucaccuugcagacg

SEQ ID NO: 2033 - RNA, 24 nt, Homo sapiens
agcgcgggcugagcgcugccaguc

SEQ ID NO: 2034 - RNA, 21 nt, Homo sapiens
auccccagauacaauggacaa

SEQ ID NO: 2035 - RNA, 22 nt, Homo sapiens
gggguuccuggggaugggauuu

SEQ ID NO: 2036 - RNA, 22 nt, Homo sapiens
uggguuccuggcaugcugauuu

SEQ ID NO: 2037 - RNA, 22 nt, Homo sapiens
ugccuacugagcugauaucagu

SEQ ID NO: 2038 - RNA, 22 nt, Homo sapiens
ugccuacugagcugaaacacag

SEQ ID NO: 2039 - RNA, 23 nt, Homo sapiens
ugaggcucuguuagccuuggcuc

SEQ ID NO: 2040 - RNA, 21 nt, Homo sapiens
aggcggagacuugggcaauug

SEQ ID NO: 2041 - RNA, 22 nt, Homo sapiens
guuuuaccaccuccaggagacu

SEQ ID NO: 2042 - RNA, 23 nt, Homo sapiens
caggcagugacuguucagacguc

SEQ ID NO: 2043 - RNA, 22 nt, Homo sapiens
uucaaguaauccaggauaggcu

SEQ ID NO: 2044 - RNA, 21 nt, Homo sapiens
uucaaguaauucaggauaggu

SEQ ID NO: 2045 - RNA, 22 nt, Homo sapiens
agggcuuagcugcuugugagca

SEQ ID NO: 2046 - RNA, 22 nt, Homo sapiens
agagcuuagcugauuggugaac

SEQ ID NO: 2047 - RNA, 22 nt, Homo sapiens
aaggagcucacagucuauugag

SEQ ID NO: 2048 - RNA, 21 nt, Homo sapiens
agggcccccccucaauccugu

SEQ ID NO: 2049 - RNA, 22 nt, Homo sapiens
ugguuuaccgucccacauacau

SEQ ID NO: 2050 - RNA, 22 nt, Homo sapiens
acugauuucuuuugguguucag

SEQ ID NO: 2051 - RNA, 24 nt, Homo sapiens
gcugguuucauauggugguuuaga

SEQ ID NO: 2052 - RNA, 22 nt, Homo sapiens
cugguuucacaugguggcuuag

SEQ ID NO: 2053 - RNA, 22 nt, Homo sapiens
ugaccgauuucuccugguguuc

SEQ ID NO: 2054 - RNA, 22 nt, Homo sapiens
gcucugacuuuauugcacuacu

SEQ ID NO: 2055 - RNA, 23 nt, Homo sapiens
acuuaaacguggauguacuugcu

SEQ ID NO: 2056 - RNA, 22 nt, Homo sapiens
acuuuaacauggaagugcuuuc

SEQ ID NO: 2057 - RNA, 22 nt, Homo sapiens
uuuaacauggggguaccugcug

SEQ ID NO: 2058 - RNA, 22 nt, Homo sapiens
acuuuaacauggaggcacuugc

SEQ ID NO: 2059 - RNA, 21 nt, Homo sapiens
ucuggcuguuguggugugcaa

SEQ ID NO: 2060 - RNA, 23 nt, Homo sapiens
ucaacaaaaucacugaugcugga

SEQ ID NO: 2061 - RNA, 21 nt, Homo sapiens
guuccugcugaacugagccag

SEQ ID NO: 2062 - RNA, 22 nt, Homo sapiens
uguaaacauccucgacuggaag

SEQ ID NO: 2063 - RNA, 22 nt, Homo sapiens
uguaaacauccuacacucagcu

SEQ ID NO: 2064 - RNA, 23 nt, Homo sapiens
uguaaacauccuacacucucagc

SEQ ID NO: 2065 - RNA, 22 nt, Homo sapiens
uguaaacauccccgacuggaag

SEQ ID NO: 2066 - RNA, 22 nt, Homo sapiens
uguaaacauccuugacuggaag

SEQ ID NO: 2067 - RNA, 20 nt, Homo sapiens
agacacuauacgagucauau

SEQ ID NO: 2068 - RNA, 21 nt, Homo sapiens
ccugucugugccugcuguaca

SEQ ID NO: 2069 - RNA, 22 nt, Homo sapiens
uccuuugccuauucuauuuaag

SEQ ID NO: 2070 - RNA, 21 nt, Homo sapiens
uucgcgggcgaaggcaaaguc

SEQ ID NO: 2071 - RNA, 22 nt, Homo sapiens
ugagggacagaugccagaagca

SEQ ID NO: 2072 - RNA, 23 nt, Homo sapiens
aucagggcuuguggaaugggaag

SEQ ID NO: 2073 - RNA, 22 nt, Homo sapiens
gcaguaguguagagauugguuu

SEQ ID NO: 2074 - RNA, 21 nt, Homo sapiens
uacccagucuccggugcagcc

SEQ ID NO: 2075 - RNA, 23 nt, Homo sapiens
cugacugaauagguagggucauu

SEQ ID NO: 2076 - RNA, 21 nt, Homo sapiens
accugaauuaccaaaagcuuu

SEQ ID NO: 2077 - RNA, 22 nt, Homo sapiens
aggggaccaaagagauauauag

SEQ ID NO: 2078 - RNA, 22 nt, Homo sapiens
aacuccaaacacucaaaacuca

SEQ ID NO: 2079 - RNA, 22 nt, Homo sapiens
caaccucgacgaucuccucagc

SEQ ID NO: 2080 - RNA, 22 nt, Homo sapiens
caaccucgaggaucuccccagc

SEQ ID NO: 2081 - RNA, 21 nt, Homo sapiens
gguggggcaaugggaucaggu

SEQ ID NO: 2082 - RNA, 22 nt, Homo sapiens
auugccucuguucuaacacaag

SEQ ID NO: 2083 - RNA, 22 nt, Homo sapiens
aaagaucuggaagugggagaca

SEQ ID NO: 2084 - RNA, 22 nt, Homo sapiens
uucagccaggcuagugcagucu

SEQ ID NO: 2085 - RNA, 21 nt, Homo sapiens
ccugcagagaggaagcccuuc

SEQ ID NO: 2086 - RNA, 21 nt, Homo sapiens
aggcaagaugcuggcauagcu

SEQ ID NO: 2087 - RNA, 22 nt, Homo sapiens
ggcuuucuagucucagcucucc

SEQ ID NO: 2088 - RNA, 23 nt, Homo sapiens
uuagggaguagaaggguggggag

SEQ ID NO: 2089 - RNA, 22 nt, Homo sapiens
ugcccugccuguuuucuccuuu

SEQ ID NO: 2090 - RNA, 23 nt, Homo sapiens
uguguacacacgugccaggcgcu

SEQ ID NO: 2091 - RNA, 25 nt, Homo sapiens
cuuccagacgcuccgccccacgucg

SEQ ID NO: 2092 - RNA, 24 nt, Homo sapiens
ugaggggccucagaccgagcuuuu

SEQ ID NO: 2093 - RNA, 22 nt, Homo sapiens
caggcgucugucuacguggcuu

SEQ ID NO: 2094 - RNA, 23 nt, Homo sapiens
ccugggcagcguguggcugaagg

SEQ ID NO: 2095 - RNA, 25 nt, Homo sapiens
ugccccaucugugcccuggguagga

SEQ ID NO: 2096 - RNA, 20 nt, Homo sapiens
ucuggccagcuacgucccca

SEQ ID NO: 2097 - RNA, 22 nt, Homo sapiens
cucucuggccgucuaccuucca

SEQ ID NO: 2098 - RNA, 23 nt, Homo sapiens
ucugggagguuguagcaguggaa

SEQ ID NO: 2099 - RNA, 21 nt, Homo sapiens
ggccagccaccaggagggcug

SEQ ID NO: 2100 - RNA, 22 nt, Homo sapiens
aaucugagaaggcgcacaaggu

SEQ ID NO: 2101 - RNA, 22 nt, Homo sapiens
aggugguccguggcgcguucgc

SEQ ID NO: 2102 - RNA, 23 nt, Homo sapiens
agguuguccguggugaguucgca

SEQ ID NO: 2103 - RNA, 23 nt, Homo sapiens
cgcauccccuagggcauuggugu

SEQ ID NO: 2104 - RNA, 22 nt, Homo sapiens
uauugcacauuacuaaguugca

SEQ ID NO: 2105 - RNA, 23 nt, Homo sapiens
gggggggcaggaggggcucaggg

SEQ ID NO: 2106 - RNA, 23 nt, Homo sapiens
gagguuuucuggguuucuguuuc

SEQ ID NO: 2107 - RNA, 22 nt, Homo sapiens
ucucugggccugugucuuaggc

SEQ ID NO: 2108 - RNA, 22 nt, Homo sapiens
cuagguauggucccagggaucc

SEQ ID NO: 2109 - RNA, 23 nt, Homo sapiens
ucaagagcaauaacgaaaaaugu

SEQ ID NO: 2110 - RNA, 21 nt, Homo sapiens
gaacggcuucauacaggaguu

SEQ ID NO: 2111 - RNA, 22 nt, Homo sapiens
aacaauauccuggugcugagug

SEQ ID NO: 2112 - RNA, 23 nt, Homo sapiens
ucccuguccuccaggagcucacg

SEQ ID NO: 2113 - RNA, 21 nt, Homo sapiens
gugcauuguaguugcauugca

SEQ ID NO: 2114 - RNA, 20 nt, Homo sapiens
gugcauugcuguugcauugc

SEQ ID NO: 2115 - RNA, 22 nt, Homo sapiens
uuauaaagcaaugagacugauu

SEQ ID NO: 2116 - RNA, 21 nt, Homo sapiens
aggggugcuaucugugauuga

SEQ ID NO: 2117 - RNA, 22 nt, Homo sapiens
gcugacuccuaguccagggcuc

SEQ ID NO: 2118 - RNA, 22 nt, Homo sapiens
uggcagugucuuagcugguugu

SEQ ID NO: 2119 - RNA, 23 nt, Homo sapiens
uaggcagugucauuagcugauug

SEQ ID NO: 2120 - RNA, 23 nt, Homo sapiens
aggcaguguaguuagcugauugc

SEQ ID NO: 2121 - RNA, 22 nt, Homo sapiens
agguagacugggauuuguuguu

SEQ ID NO: 2122 - RNA, 23 nt, Homo sapiens
uuuagugugauaauggcguuuga

SEQ ID NO: 2123 - RNA, 23 nt, Homo sapiens
ugaggauggauagcaaggaagcc

SEQ ID NO: 2124 - RNA, 21 nt, Homo sapiens
uuagugaaggcuauuuuaauu

SEQ ID NO: 2125 - RNA, 22 nt, Homo sapiens
gcaugugaugaagcaaaucagu

SEQ ID NO: 2126 - RNA, 22 nt, Homo sapiens
uguuguacuuuuuuuuuuguuc

SEQ ID NO: 2127 - RNA, 23 nt, Homo sapiens
ccacuuggaucugaaggcugccc

SEQ ID NO: 2128 - RNA, 22 nt, Homo sapiens
uuaucagaaucuccagggguac

SEQ ID NO: 2129 - RNA, 22 nt, Homo sapiens
augaagugcacucaugauaugu

SEQ ID NO: 2130 - RNA, 22 nt, Homo sapiens
aaagacauaguugcaagauggg

SEQ ID NO: 2131 - RNA, 22 nt, Homo sapiens
ucagcaggcaggcuggugcagc

SEQ ID NO: 2132 - RNA, 22 nt, Homo sapiens
gugggcugggcugggcugggcc

SEQ ID NO: 2133 - RNA, 22 nt, Homo sapiens
caggcacgggagcucaggugag

SEQ ID NO: 2134 - RNA, 20 nt, Homo sapiens
aggcaugggaggucagguga

SEQ ID NO: 2135 - RNA, 24 nt, Homo sapiens
aauccuuggaaccuaggugugagu

SEQ ID NO: 2136 - RNA, 22 nt, Homo sapiens
cggguggaucacgaugcaauuu

SEQ ID NO: 2137 - RNA, 23 nt, Homo sapiens
agggacuuuugggggcagaugug

SEQ ID NO: 2138 - RNA, 22 nt, Homo sapiens
agggacuuucaggggcagcugu

SEQ ID NO: 2139 - RNA, 21 nt, Homo sapiens
gcuggucugcguggugcucgg

SEQ ID NO: 2140 - RNA, 22 nt, Homo sapiens
aacucugucuucacucaugagu

SEQ ID NO: 2141 - RNA, 22 nt, Homo sapiens
aaagacccauugaggagaaggu

SEQ ID NO: 2142 - RNA, 23 nt, Homo sapiens
uauggggcuucuguagagauuuc

SEQ ID NO: 2143 - RNA, 22 nt, Homo sapiens
acuguugcuaauaugcaacucu

SEQ ID NO: 2144 - RNA, 22 nt, Homo sapiens
caguggccagagcccugcagug

SEQ ID NO: 2145 - RNA, 20 nt, Homo sapiens
uccguacaaacucugcugug

SEQ ID NO: 2146 - RNA, 23 nt, Homo sapiens
ugaggauauggcagggaagggga

SEQ ID NO: 2147 - RNA, 22 nt, Homo sapiens
gacucacucacaggauugugca

SEQ ID NO: 2148 - RNA, 22 nt, Homo sapiens
uaguggaugaugcacucugugc

SEQ ID NO: 2149 - RNA, 22 nt, Homo sapiens
cuacuucuaccuguguuaucau

SEQ ID NO: 2150 - RNA, 21 nt, Homo sapiens
aguggcaaagucuuuccauau

SEQ ID NO: 2151 - RNA, 22 nt, Homo sapiens
ugugauaucaugguuccuggga

SEQ ID NO: 2152 - RNA, 22 nt, Homo sapiens
ugugauaucaugguuccuggga

SEQ ID NO: 2153 - RNA, 23 nt, Homo sapiens
aguggaugauggagacucgguac

SEQ ID NO: 2154 - RNA, 24 nt, Homo sapiens
ccugcuggucaggaguggauacug

SEQ ID NO: 2155 - RNA, 22 nt, Homo sapiens
agaucgaccguguuauauucgc

SEQ ID NO: 2156 - RNA, 22 nt, Homo sapiens
caggucacgucucugcaguuac

SEQ ID NO: 2157 - RNA, 20 nt, Homo sapiens
acucaaacugugggggcacu

SEQ ID NO: 2158 - RNA, 22 nt, Homo sapiens
acucaaaagauggcggcacuuu

SEQ ID NO: 2159 - RNA, 23 nt, Homo sapiens
ccucaaauguggagcacuauucu

SEQ ID NO: 2160 - RNA, 22 nt, Homo sapiens
acucaaaaugggggcgcuuucc

SEQ ID NO: 2161 - RNA, 22 nt, Homo sapiens
uuauaauacaaccugauaagug

SEQ ID NO: 2162 - RNA, 22 nt, Homo sapiens
auauaauacaaccugcuaagug

SEQ ID NO: 2163 - RNA, 22 nt, Homo sapiens
auaauacaaccugcuaagugcu

SEQ ID NO: 2164 - RNA, 21 nt, Homo sapiens
gguagauuuuccuucuauggu

SEQ ID NO: 2165 - RNA, 22 nt, Homo sapiens
guagauucuccuucuaugagua

SEQ ID NO: 2166 - RNA, 22 nt, Homo sapiens
cguggauauuccuucuauguuu

SEQ ID NO: 2167 - RNA, 21 nt, Homo sapiens
gguggauauuccuucuauguu

SEQ ID NO: 2168 - RNA, 22 nt, Homo sapiens
agagguugcccuuggugaauuc

SEQ ID NO: 2169 - RNA, 22 nt, Homo sapiens
cuccugacuccagguccugugu

SEQ ID NO: 2170 - RNA, 21 nt, Homo sapiens
ugguagacuauggaacguagg

SEQ ID NO: 2171 - RNA, 22 nt, Homo sapiens
ugguugaccauagaacaugcgc

SEQ ID NO: 2172 - RNA, 22 nt, Homo sapiens
agcgagguugcccuuuguauau

SEQ ID NO: 2173 - RNA, 22 nt, Homo sapiens
gaaguuguucgugguggauucg

SEQ ID NO: 2174 - RNA, 22 nt, Homo sapiens
agaucagaaggugauuguggcu

SEQ ID NO: 2175 - RNA, 21 nt, Homo sapiens
auguccauauuauggguuagu

SEQ ID NO: 2176 - RNA, 22 nt, Homo sapiens
uuugggacugaucuugaugucu

SEQ ID NO: 2177 - RNA, 23 nt, Homo sapiens
ucaaggccagaggucccacagca

SEQ ID NO: 2178 - RNA, 22 nt, Homo sapiens
aagagaacugaaaguggagccu

SEQ ID NO: 2179 - RNA, 21 nt, Homo sapiens
gccuaucacauaucugccugu

SEQ ID NO: 2180 - RNA, 23 nt, Homo sapiens
ugaagcucuaagguuccgccugc

SEQ ID NO: 2181 - RNA, 22 nt, Homo sapiens
ucagguguggaaacugaggcag

SEQ ID NO: 2182 - RNA, 20 nt, Homo sapiens
guggguuggggcgggcucug

SEQ ID NO: 2183 - RNA, 22 nt, Homo sapiens
aagcaauacuguuaccugaaau

SEQ ID NO: 2184 - RNA, 21 nt, Homo sapiens
ugugcagcaggccaaccgaga

SEQ ID NO: 2185 - RNA, 23 nt, Homo sapiens
agguuacccgagcaacuuugcau

SEQ ID NO: 2186 - RNA, 21 nt, Homo sapiens
agguugucugugaugaguucg

SEQ ID NO: 2187 - RNA, 21 nt, Homo sapiens
uaguagaccguauagcguacg

SEQ ID NO: 2188 - RNA, 23 nt, Homo sapiens
uggucgaccaguuggaaaguaau

SEQ ID NO: 2189 - RNA, 23 nt, Homo sapiens
ugaggggcagagagcgagacuuu

SEQ ID NO: 2190 - RNA, 22 nt, Homo sapiens
cagcagcaauucauguuuugaa

SEQ ID NO: 2191 - RNA, 23 nt, Homo sapiens
aaugacacgaucacucccguuga

SEQ ID NO: 2192 - RNA, 21 nt, Homo sapiens
ugucuugcaggccgucaugca

SEQ ID NO: 2193 - RNA, 23 nt, Homo sapiens
ucuuggaguaggucauugggugg

SEQ ID NO: 2194 - RNA, 22 nt, Homo sapiens
uacggugagccugucauuauuc

SEQ ID NO: 2195 - RNA, 22 nt, Homo sapiens
aguugccuuuuuguucccaugc

SEQ ID NO: 2196 - RNA, 21 nt, Homo sapiens
cgucccaccccccacuccugu

SEQ ID NO: 2197 - RNA, 21 nt, Homo sapiens
augucccacccccacuccugu

SEQ ID NO: 2198 - RNA, 22 nt, Homo sapiens
guccacuucugccugcccugcc

SEQ ID NO: 2199 - RNA, 22 nt, Homo sapiens
agauuguuucuuuugccgugca

SEQ ID NO: 2200 - RNA, 22 nt, Homo sapiens
auuucccugccauucccuuggc

SEQ ID NO: 2201 - RNA, 21 nt, Homo sapiens
uuagucucaugaucagacaca

SEQ ID NO: 2202 - RNA, 22 nt, Homo sapiens
aacccagugggcuauggaaaug

SEQ ID NO: 2203 - RNA, 22 nt, Homo sapiens
aggcaguguauuguuagcuggc

SEQ ID NO: 2204 - RNA, 25 nt, Homo sapiens
uaggcaguguauugcuagcggcugu

SEQ ID NO: 2205 - RNA, 22 nt, Homo sapiens
uuuugcgauguguuccuaauau

SEQ ID NO: 2206 - RNA, 22 nt, Homo sapiens
uuuugcaauauguuccugaaua

SEQ ID NO: 2207 - RNA, 20 nt, Homo sapiens
ccugcguguuuucuguccaa

SEQ ID NO: 2208 - RNA, 20 nt, Homo sapiens
ccugcguguuuucuguccaa

SEQ ID NO: 2209 - RNA, 22 nt, Homo sapiens
auagcagcaugaaccugucuca

SEQ ID NO: 2210 - RNA, 21 nt, Homo sapiens
auagcagcauaagccugucuc

SEQ ID NO: 2211 - RNA, 22 nt, Homo sapiens
aacuguuugcagaggaaacuga

SEQ ID NO: 2212 - RNA, 22 nt, Homo sapiens
aggccaucagcaguccaaugaa

SEQ ID NO: 2213 - RNA, 21 nt, Homo sapiens
ugugguagauauaugcacgau

SEQ ID NO: 2214 - RNA, 22 nt, Homo sapiens
acccuaucaauauugucucugc

SEQ ID NO: 2215 - RNA, 22 nt, Homo sapiens
uaugugccuuuggacuacaucg

SEQ ID NO: 2216 - RNA, 23 nt, Homo sapiens
gagggcagcguggguguggcgga

SEQ ID NO: 2217 - RNA, 20 nt, Homo sapiens
auaugccuggcuagcuccuc

SEQ ID NO: 2218 - RNA, 21 nt, Homo sapiens
acucggcugcgguggacaagu

SEQ ID NO: 2219 - RNA, 22 nt, Homo sapiens
uugcuaaguaggcugagauuga

SEQ ID NO: 2220 - RNA, 23 nt, Homo sapiens
ugggccagggagcagcugguggg

SEQ ID NO: 2221 - RNA, 19 nt, Homo sapiens
accaggcaagaaauauugu

SEQ ID NO: 2222 - RNA, 22 nt, Homo sapiens
acugggaagaggagcugaggga

SEQ ID NO: 2223 - RNA, 24 nt, Homo sapiens
ugggcgaggggugggcucucagag

SEQ ID NO: 2224 - RNA, 19 nt, Homo sapiens
ucaggccucuuucuaccuu

SEQ ID NO: 2225 - RNA, 22 nt, Homo sapiens
aggggacugguuaauagaacua

SEQ ID NO: 2226 - RNA, 22 nt, Homo sapiens
ucucugagcaaggcuuaacacc

SEQ ID NO: 2227 - RNA, 22 nt, Homo sapiens
caccggggauggcagagggucg

SEQ ID NO: 2228 - RNA, 22 nt, Homo sapiens
cugccaugucuaagaagaaaac

SEQ ID NO: 2229 - RNA, 19 nt, Homo sapiens
uugccaugucuaagaagaa

SEQ ID NO: 2230 - RNA, 22 nt, Homo sapiens
aacuagcucuguggauccugac

SEQ ID NO: 2231 - RNA, 22 nt, Homo sapiens
uuagccaauuguccaucuuuag

SEQ ID NO: 2232 - RNA, 22 nt, Homo sapiens
uggggugcccacuccgcaaguu

SEQ ID NO: 2233 - RNA, 23 nt, Homo sapiens
cugggggacgcgugagcgcgagc

SEQ ID NO: 2234 - RNA, 21 nt, Homo sapiens
auacaugucagauuguaugcc

SEQ ID NO: 2235 - RNA, 22 nt, Homo sapiens
acuggggagcagaaggagaacc

SEQ ID NO: 2236 - RNA, 23 nt, Homo sapiens
agggaaaaaaaaaaggauuuguc

SEQ ID NO: 2237 - RNA, 22 nt, Homo sapiens
aagcgaccaugauguaacuuca

SEQ ID NO: 2238 - RNA, 22 nt, Homo sapiens
accgaagacugugcgcuaaucu

SEQ ID NO: 2239 - RNA, 21 nt, Homo sapiens
gagccaguggugagacaguga

SEQ ID NO: 2240 - RNA, 22 nt, Homo sapiens
uuguucuuuggucuuucagcca

SEQ ID NO: 2241 - RNA, 23 nt, Homo sapiens
agaacucuugcagucuuagaugu

SEQ ID NO: 2242 - RNA, 22 nt, Homo sapiens
cucucuacugacuugcaacaua

SEQ ID NO: 2243 - RNA, 26 nt, Homo sapiens
cccagggcuuggaguggggcaagguu

SEQ ID NO: 2244 - RNA, 22 nt, Homo sapiens
cagcccuccucccgcacccaaa

SEQ ID NO: 2245 - RNA, 22 nt, Homo sapiens
gagcaggcgaggcugggcugaa

SEQ ID NO: 2246 - RNA, 23 nt, Homo sapiens
guccuccaggccaugagcugcgg

SEQ ID NO: 2247 - RNA, 23 nt, Homo sapiens
auacugugaauuucacugucaca

SEQ ID NO: 2248 - RNA, 22 nt, Homo sapiens
agguguuauccuauccauuugc

SEQ ID NO: 2249 - RNA, 22 nt, Homo sapiens
caggaggcagugggcgagcagg

SEQ ID NO: 2250 - RNA, 22 nt, Homo sapiens
agggggcgcagucacugacgug

SEQ ID NO: 2251 - RNA, 22 nt, Homo sapiens
agaagauugcagaguaaguucc

SEQ ID NO: 2252 - RNA, 22 nt, Homo sapiens
ucuggggaugaggacagugugu

SEQ ID NO: 2253 - RNA, 22 nt, Homo sapiens
uuggccaccacaccuaccccuu

SEQ ID NO: 2254 - RNA, 23 nt, Homo sapiens
uagcaauacaguacaaauauagu

SEQ ID NO: 2255 - RNA, 22 nt, Homo sapiens
gacacuaggcaugugagugauu

SEQ ID NO: 2256 - RNA, 23 nt, Homo sapiens
gccccggcgcgggcggguucugg

SEQ ID NO: 2257 - RNA, 21 nt, Homo sapiens
agagaugccgccuugcuccuu

SEQ ID NO: 2258 - RNA, 22 nt, Homo sapiens
acaacagugacuugcucuccaa

SEQ ID NO: 2259 - RNA, 23 nt, Homo sapiens
ugcaucaggccagaagacaugag

SEQ ID NO: 2260 - RNA, 22 nt, Homo sapiens
uccaguacaggucucucauuuc

SEQ ID NO: 2261 - RNA, 22 nt, Homo sapiens
uucucccacuaccaggcuccca

SEQ ID NO: 2262 - RNA, 22 nt, Homo sapiens
aacucugaccccuuagguugau

SEQ ID NO: 2263 - RNA, 22 nt, Homo sapiens
aaguuggcugcaguuaaggugg

SEQ ID NO: 2264 - RNA, 22 nt, Homo sapiens
uccauguuuccuucccccuucu

SEQ ID NO: 2265 - RNA, 22 nt, Homo sapiens
uaggccacagccacccaugugu

SEQ ID NO: 2266 - RNA, 22 nt, Homo sapiens
ccuggcauauuugguauaacuu

SEQ ID NO: 2267 - RNA, 23 nt, Homo sapiens
ggcaggagggcugugccagguug

SEQ ID NO: 2268 - RNA, 24 nt, Homo sapiens
ugggggagccaugagauaagagca

SEQ ID NO: 2269 - RNA, 23 nt, Homo sapiens
aacugaaccaggagugagcuucg

SEQ ID NO: 2270 - RNA, 21 nt, Homo sapiens
agacccugcagccuucccacc

SEQ ID NO: 2271 - RNA, 23 nt, Homo sapiens
agggccagaggagccuggagugg

SEQ ID NO: 2272 - RNA, 21 nt, Homo sapiens
aucugccagcuuccacagugg

SEQ ID NO: 2273 - RNA, 23 nt, Homo sapiens
ugggaggggagaggcagcaagca

SEQ ID NO: 2274 - RNA, 22 nt, Homo sapiens
ugcugggggccacaugagugug

SEQ ID NO: 2275 - RNA, 23 nt, Homo sapiens
uguagagcagggagcaggaagcu

SEQ ID NO: 2276 - RNA, 22 nt, Homo sapiens
aaucccaaugcuagacccggug

SEQ ID NO: 2277 - RNA, 22 nt, Homo sapiens
ccuaauuugaacaccuucggua

SEQ ID NO: 2278 - RNA, 22 nt, Homo sapiens
accagcgcguuuucaguuucau

SEQ ID NO: 2279 - RNA, 22 nt, Homo sapiens
aggacugauccucucgggcagg

SEQ ID NO: 2280 - RNA, 23 nt, Homo sapiens
ucaggcaaagggauauuuacaga

SEQ ID NO: 2281 - RNA, 23 nt, Homo sapiens
uggccggaugggacaggaggcau

SEQ ID NO: 2282 - RNA, 23 nt, Homo sapiens
ugaguggggcucccgggacggcg

SEQ ID NO: 2283 - RNA, 23 nt, Homo sapiens
ccggucccaggagaaccugcaga

SEQ ID NO: 2284 - RNA, 22 nt, Homo sapiens
agggaaggaggcuuggucuuag

SEQ ID NO: 2285 - RNA, 22 nt, Homo sapiens
ugcggggacaggccagggcauc

SEQ ID NO: 2286 - RNA, 22 nt, Homo sapiens
cucgggcggaggugguugagug

SEQ ID NO: 2287 - RNA, 22 nt, Homo sapiens
caaggccaaaggaagagaacag

SEQ ID NO: 2288 - RNA, 22 nt, Homo sapiens
uuucccuucagagccuggcuuu

SEQ ID NO: 2289 - RNA, 23 nt, Homo sapiens
cagggaggcgcucacucucugcu

SEQ ID NO: 2290 - RNA, 23 nt, Homo sapiens
aggccucugugacgucacggugu

SEQ ID NO: 2291 - RNA, 23 nt, Homo sapiens
gugagugggagccgguggggcug

SEQ ID NO: 2292 - RNA, 22 nt, Homo sapiens
uuuagauugaacaugaaguuag

SEQ ID NO: 2293 - RNA, 21 nt, Homo sapiens
acaaggugugcaugccugacc

SEQ ID NO: 2294 - RNA, 21 nt, Homo sapiens
ccaaaucuugaucagaagccu

SEQ ID NO: 2295 - RNA, 21 nt, Homo sapiens
cgccugcccagcccuccugcu

SEQ ID NO: 2296 - RNA, 21 nt, Homo sapiens
uggauguggaaggaguuaucu

SEQ ID NO: 2297 - RNA, 21 nt, Homo sapiens
ucugaaagagcaguugguguu

SEQ ID NO: 2298 - RNA, 22 nt, Homo sapiens
auucucucuggaucccauggau

SEQ ID NO: 2299 - RNA, 24 nt, Homo sapiens
ggugggauggagagaagguaugag

SEQ ID NO: 2300 - RNA, 22 nt, Homo sapiens
ugaucaggcaaaauugcagacu

SEQ ID NO: 2301 - RNA, 22 nt, Homo sapiens
ucugguauguaguagguaauaa

SEQ ID NO: 2302 - RNA, 22 nt, Homo sapiens
guggaccaggauggcaagggcu

SEQ ID NO: 2303 - RNA, 22 nt, Homo sapiens
uucuagaugagagauauauaua

SEQ ID NO: 2304 - RNA, 22 nt, Homo sapiens
aauucuguaaaggaagaagagg

SEQ ID NO: 2305 - RNA, 21 nt, Homo sapiens
uagcggggauuccaauauugg

SEQ ID NO: 2306 - RNA, 22 nt, Homo sapiens
uucuggauaugaagacaaucaa

SEQ ID NO: 2307 - RNA, 21 nt, Homo sapiens
ggcgcgcccagcucccgggcu

SEQ ID NO: 2308 - RNA, 22 nt, Homo sapiens
ugagaccaggacuggaugcacc

SEQ ID NO: 2309 - RNA, 22 nt, Homo sapiens
gcggggguggcggcggcauccc

SEQ ID NO: 2310 - RNA, 22 nt, Homo sapiens
guauacaccugauauguguaug

SEQ ID NO: 2311 - RNA, 20 nt, Homo sapiens
aucgcuuuaccauucauguu

SEQ ID NO: 2312 - RNA, 24 nt, Homo sapiens
acauccugcuccacagggcagagg

SEQ ID NO: 2313 - RNA, 21 nt, Homo sapiens
agaaguggcuaauaauauuga

SEQ ID NO: 2314 - RNA, 22 nt, Homo sapiens
ugucuauacucugucacuuuac

SEQ ID NO: 2315 - RNA, 21 nt, Homo sapiens
gacagagugccacuuacugaa

SEQ ID NO: 2316 - RNA, 22 nt, Homo sapiens
uucgguauacuuugugaauugg

SEQ ID NO: 2317 - RNA, 22 nt, Homo sapiens
aucuaaaugcagcaugccaguc

SEQ ID NO: 2318 - RNA, 21 nt, Homo sapiens
aguggaccgaggaaggaagga

SEQ ID NO: 2319 - RNA, 22 nt, Homo sapiens
uauggagguucuagaccauguu

SEQ ID NO: 2320 - RNA, 21 nt, Homo sapiens
uuggacgguaagguuaagcaa

SEQ ID NO: 2321 - RNA, 22 nt, Homo sapiens
aagacgggaggaaagaagggag

SEQ ID NO: 2322 - RNA, 22 nt, Homo sapiens
agaggcuggccgugaugaauuc

SEQ ID NO: 2323 - RNA, 22 nt, Homo sapiens
uccuguacugagcugccccgag

SEQ ID NO: 2324 - RNA, 22 nt, Homo sapiens
gugguuaucccugcuguguucg

SEQ ID NO: 2325 - RNA, 22 nt, Homo sapiens
gugguuaucccuguccuguucg

SEQ ID NO: 2326 - RNA, 21 nt, Homo sapiens
cccagauaauggcacucucaa

SEQ ID NO: 2327 - RNA, 22 nt, Homo sapiens
ggucguaugugugacgccauuu

SEQ ID NO: 2328 - RNA, 20 nt, Homo sapiens
ccauggaucuccaggugggu

SEQ ID NO: 2329 - RNA, 22 nt, Homo sapiens
aguggggaacccuuccaugagg

SEQ ID NO: 2330 - RNA, 22 nt, Homo sapiens
uuguacaugguaggcuuucauu

SEQ ID NO: 2331 - RNA, 23 nt, Homo sapiens
agguuguccguguugucuucucu

SEQ ID NO: 2332 - RNA, 22 nt, Homo sapiens
gaaguugcccauguuauuuucg

SEQ ID NO: 2333 - RNA, 21 nt, Homo sapiens
cagcagcacacugugguuugu

SEQ ID NO: 2334 - RNA, 21 nt, Homo sapiens
ugcuguauugucagguaguga

SEQ ID NO: 2335 - RNA, 21 nt, Homo sapiens
uuaagacuugcagugauguuu

SEQ ID NO: 2336 - RNA, 21 nt, Homo sapiens
acagacuugcugugauguuca

SEQ ID NO: 2337 - RNA, 22 nt, Homo sapiens
caguucagaaguguuccugagu

SEQ ID NO: 2338 - RNA, 24 nt, Homo sapiens
agggcuggacucagcggcggagcu

SEQ ID NO: 2339 - RNA, 24 nt, Homo sapiens
aauuugguuucugaggcacuuagu

SEQ ID NO: 2340 - RNA, 23 nt, Homo sapiens
ucacaacaaccuugcaggguaga

SEQ ID NO: 2341 - RNA, 22 nt, Homo sapiens
ugaggacagggcaaauucacga

SEQ ID NO: 2342 - RNA, 21 nt, Homo sapiens
uugccagggcaggagguggaa

SEQ ID NO: 2343 - RNA, 22 nt, Homo sapiens
uagagucuggcugauaugguuu

SEQ ID NO: 2344 - RNA, 22 nt, Homo sapiens
ugaggcccuuggggcacagugg

SEQ ID NO: 2345 - RNA, 24 nt, Homo sapiens
uuggacuuuuucagauuuggggau

SEQ ID NO: 2346 - RNA, 23 nt, Homo sapiens
uaauccuugcuaccugggugaga

SEQ ID NO: 2347 - RNA, 18 nt, Homo sapiens
aauccuugcuaccugggu

SEQ ID NO: 2348 - RNA, 22 nt, Homo sapiens
agggggauggcagagcaaaauu

SEQ ID NO: 2349 - RNA, 21 nt, Homo sapiens
uauauauacagccaugcacuc

SEQ ID NO: 2350 - RNA, 22 nt, Homo sapiens
aauccuuugucccugggugaga

SEQ ID NO: 2351 - RNA, 21 nt, Homo sapiens
auccuugcuaucugggugcua

SEQ ID NO: 2352 - RNA, 23 nt, Homo sapiens
uagcagcgggaacaguucugcag

SEQ ID NO: 2353 - RNA, 22 nt, Homo sapiens
agacccuggucugcacucuauc

SEQ ID NO: 2354 - RNA, 22 nt, Homo sapiens
gggagccaggaaguauugaugu

SEQ ID NO: 2355 - RNA, 22 nt, Homo sapiens
uauucaggaagguguuacuuaa

SEQ ID NO: 2356 - RNA, 23 nt, Homo sapiens
uacuccagagggcgucacucaug

SEQ ID NO: 2357 - RNA, 24 nt, Homo sapiens
cagggcucagggauuggauggagg

SEQ ID NO: 2358 - RNA, 21 nt, Homo sapiens
gugggauuucugaguagcauc

SEQ ID NO: 2359 - RNA, 22 nt, Homo sapiens
uacugcagacguggcaaucaug

SEQ ID NO: 2360 - RNA, 21 nt, Homo sapiens
uacugcagacaguggcaauca

SEQ ID NO: 2361 - RNA, 22 nt, Homo sapiens
uacucaggagaguggcaaucac

SEQ ID NO: 2362 - RNA, 21 nt, Homo sapiens
gugucuuuugcucugcaguca

SEQ ID NO: 2363 - RNA, 23 nt, Homo sapiens
cacucagccuugagggcacuuuc

SEQ ID NO: 2364 - RNA, 18 nt, Homo sapiens
uucacagggaggugucau

SEQ ID NO: 2365 - RNA, 22 nt, Homo sapiens
uucacaaggaggugucauuuau

SEQ ID NO: 2366 - RNA, 22 nt, Homo sapiens
uucucaaggaggugucguuuau

SEQ ID NO: 2367 - RNA, 23 nt, Homo sapiens
uacucuggagagugacaaucaug

SEQ ID NO: 2368 - RNA, 22 nt, Homo sapiens
uucucaagagggaggcaaucau

SEQ ID NO: 2369 - RNA, 24 nt, Homo sapiens
uucuccaaaagaaagcacuuucug

SEQ ID NO: 2370 - RNA, 23 nt, Homo sapiens
uucucgaggaaagaagcacuuuc

SEQ ID NO: 2371 - RNA, 22 nt, Homo sapiens
aucuggagguaagaagcacuuu

SEQ ID NO: 2372 - RNA, 22 nt, Homo sapiens
ccucuagauggaagcacugucu

SEQ ID NO: 2373 - RNA, 22 nt, Homo sapiens
ugggaugagggauugaagugga

SEQ ID NO: 2374 - RNA, 24 nt, Homo sapiens
ucugggcacaggcggauggacagg

SEQ ID NO: 2375 - RNA, 20 nt, Homo sapiens
cugcaaagggaagcccuuuc

SEQ ID NO: 2376 - RNA, 23 nt, Homo sapiens
ucucuggagggaagcacuuucug

SEQ ID NO: 2377 - RNA, 22 nt, Homo sapiens
cucuagagggaagcacuuucug

SEQ ID NO: 2378 - RNA, 22 nt, Homo sapiens
cucuagagggaagcgcuuucug

SEQ ID NO: 2379 - RNA, 22 nt, Homo sapiens
cucuagagggaagcacuuucuc

SEQ ID NO: 2380 - RNA, 22 nt, Homo sapiens
aaccccuaaggcaacuggaugg

SEQ ID NO: 2381 - RNA, 22 nt, Homo sapiens
agggaaggggacgaggguuggg

SEQ ID NO: 2382 - RNA, 23 nt, Homo sapiens
caauggcacaaacucauucuuga

SEQ ID NO: 2383 - RNA, 22 nt, Homo sapiens
cucuagagggaagcgcuuucug

SEQ ID NO: 2384 - RNA, 22 nt, Homo sapiens
cucuagagggaagcgcuuucug

SEQ ID NO: 2385 - RNA, 22 nt, Homo sapiens
cucuagagggaagcgcuuucug

SEQ ID NO: 2386 - RNA, 25 nt, Homo sapiens
ccuccaaagggaagcgcuuucuguu

SEQ ID NO: 2387 - RNA, 22 nt, Homo sapiens
uucuccaaaagggagcacuuuc

SEQ ID NO: 2388 - RNA, 21 nt, Homo sapiens
cuccagagggaaguacuuucu

SEQ ID NO: 2389 - RNA, 22 nt, Homo sapiens
cucuagagggaagcacuuucug

SEQ ID NO: 2390 - RNA, 20 nt, Homo sapiens
cuacaaagggaagcccuuuc

SEQ ID NO: 2391 - RNA, 22 nt, Homo sapiens
ccucuaaagggaagcgcuuucu

SEQ ID NO: 2392 - RNA, 23 nt, Homo sapiens
ucuagaggaagcacuuucuguuu

SEQ ID NO: 2393 - RNA, 22 nt, Homo sapiens
cucuagagggaagcgcuuucug

SEQ ID NO: 2394 - RNA, 22 nt, Homo sapiens
cucuagagggaagcgcuuucug

SEQ ID NO: 2395 - RNA, 22 nt, Homo sapiens
cuacaaagggaagcacuuucuc

SEQ ID NO: 2396 - RNA, 21 nt, Homo sapiens
cuccagagggaugcacuuucu

SEQ ID NO: 2397 - RNA, 23 nt, Homo sapiens
cucuugagggaagcacuuucugu

SEQ ID NO: 2398 - RNA, 22 nt, Homo sapiens
caugccuugaguguaggaccgu

SEQ ID NO: 2399 - RNA, 22 nt, Homo sapiens
ggagaaauuauccuuggugugu

SEQ ID NO: 2400 - RNA, 25 nt, Homo sapiens
aaaggauucugcugucggucccacu

SEQ ID NO: 2401 - RNA, 23 nt, Homo sapiens
ucggggaucaucaugucacgaga

SEQ ID NO: 2402 - RNA, 22 nt, Homo sapiens
ucaguaaauguuuauuagauga

SEQ ID NO: 2403 - RNA, 22 nt, Homo sapiens
aaaaguaauugcgaguuuuacc

SEQ ID NO: 2404 - RNA, 20 nt, Homo sapiens
aaaagugauugcaguguuug

SEQ ID NO: 2405 - RNA, 23 nt, Homo sapiens
ugcaaaaguaauugcaguuuuug

SEQ ID NO: 2406 - RNA, 22 nt, Homo sapiens
aaaaguaauugcgguuuuugcc

SEQ ID NO: 2407 - RNA, 22 nt, Homo sapiens
agaaguaacuacgguuuuugca

SEQ ID NO: 2408 - RNA, 19 nt, Homo sapiens
aaaaguaauugcggucuuu

SEQ ID NO: 2409 - RNA, 22 nt, Homo sapiens
gaaaguaauugcuguuuuugcc

SEQ ID NO: 2410 - RNA, 21 nt, Homo sapiens
aaaaguaauugcaguuuuugc

SEQ ID NO: 2411 - RNA, 22 nt, Homo sapiens
aaaaguaauugcggguuuugcc

SEQ ID NO: 2412 - RNA, 22 nt, Homo sapiens
aaaaguuauugcgguuuuggcu

SEQ ID NO: 2413 - RNA, 21 nt, Homo sapiens
aaaaguaauugcgguuuuugc

SEQ ID NO: 2414 - RNA, 18 nt, Homo sapiens
aaaaguacuugcggauuu

SEQ ID NO: 2415 - RNA, 21 nt, Homo sapiens
aaaaguaauugugguuuuugc

SEQ ID NO: 2416 - RNA, 22 nt, Homo sapiens
caaaagugauugugguuuuugc

SEQ ID NO: 2417 - RNA, 22 nt, Homo sapiens
aaaaguaauugugguuuuggcc

SEQ ID NO: 2418 - RNA, 22 nt, Homo sapiens
aaaaguaauugcgguuuuugcc

SEQ ID NO: 2419 - RNA, 22 nt, Homo sapiens
aaaaguaauugugguuuuugcc

SEQ ID NO: 2420 - RNA, 22 nt, Homo sapiens
caaaagcaaucgcgguuuuugc

SEQ ID NO: 2421 - RNA, 22 nt, Homo sapiens
ugcaaaaguaaucacaguuuuu

SEQ ID NO: 2422 - RNA, 23 nt, Homo sapiens
ugcaaaaguaauugcaguuuuug

SEQ ID NO: 2423 - RNA, 22 nt, Homo sapiens
aaaaguaaucgcgguuuuuguc

SEQ ID NO: 2424 - RNA, 22 nt, Homo sapiens
aaaaguaauugcggucuuuggu

SEQ ID NO: 2425 - RNA, 22 nt, Homo sapiens
aaaaguaauugcgguuuuugcc

SEQ ID NO: 2426 - RNA, 21 nt, Homo sapiens
caaaagugaucgugguuuuug

SEQ ID NO: 2427 - RNA, 23 nt, Homo sapiens
ugcaaaaguaauugcaguuuuug

SEQ ID NO: 2428 - RNA, 20 nt, Homo sapiens
agugccugagggaguaagag

SEQ ID NO: 2429 - RNA, 23 nt, Homo sapiens
agugccugagggaguaagagccc

SEQ ID NO: 2430 - RNA, 22 nt, Homo sapiens
augugccugagggaguaagaca

SEQ ID NO: 2431 - RNA, 22 nt, Homo sapiens
gaaaucaagcgugggugagacc

SEQ ID NO: 2432 - RNA, 21 nt, Homo sapiens
guuuaaccuuuugccuguugg

SEQ ID NO: 2433 - RNA, 22 nt, Homo sapiens
gaugagcucauuguaauaugag

SEQ ID NO: 2434 - RNA, 21 nt, Homo sapiens
caauucucaaaggagccuccc

SEQ ID NO: 2435 - RNA, 21 nt, Homo sapiens
uaugguacuccuuaagcuaac

SEQ ID NO: 2436 - RNA, 22 nt, Homo sapiens
ugcuggcucauuucauaugugu

SEQ ID NO: 2437 - RNA, 22 nt, Homo sapiens
agccuuccaggagaaauggaga

SEQ ID NO: 2438 - RNA, 22 nt, Homo sapiens
uaggcacacuuaaaguuauagc

SEQ ID NO: 2439 - RNA, 22 nt, Homo sapiens
aaacuaauauacccauauucug

SEQ ID NO: 2440 - RNA, 22 nt, Homo sapiens
cagggaaaugggaagaacuaga

SEQ ID NO: 2441 - RNA, 22 nt, Homo sapiens
ugaaguaccagcuacucgagag

SEQ ID NO: 2442 - RNA, 22 nt, Homo sapiens
uauccagcuuguuacuauaugc

SEQ ID NO: 2443 - RNA, 18 nt, Homo sapiens
auggucaccuccgggacu

SEQ ID NO: 2444 - RNA, 21 nt, Homo sapiens
acuggcauuagugggacuuuu

SEQ ID NO: 2445 - RNA, 21 nt, Homo sapiens
ggcugggugcucuugugcagu

SEQ ID NO: 2446 - RNA, 21 nt, Homo sapiens
uugccauacauagacuuuauu

SEQ ID NO: 2447 - RNA, 21 nt, Homo sapiens
ugggagcuaagcuauggguau

SEQ ID NO: 2448 - RNA, 22 nt, Homo sapiens
aucaaggaucuuaaacuuugcc

SEQ ID NO: 2449 - RNA, 22 nt, Homo sapiens
ugccccaacaaggaaggacaag

SEQ ID NO: 2450 - RNA, 22 nt, Homo sapiens
aaagguaauugcaguuuuuccc

SEQ ID NO: 2451 - RNA, 23 nt, Homo sapiens
ugagugugugugugugagugugu

SEQ ID NO: 2452 - RNA, 22 nt, Homo sapiens
auucuaauuucuccacgucuuu

SEQ ID NO: 2453 - RNA, 22 nt, Homo sapiens
ucgcgguuugugccagaugacg

SEQ ID NO: 2454 - RNA, 22 nt, Homo sapiens
uaaugauucaucagacucagau

SEQ ID NO: 2455 - RNA, 23 nt, Homo sapiens
uuacaguuguucaaccaguuacu

SEQ ID NO: 2456 - RNA, 22 nt, Homo sapiens
uuaugguuugccugggacugag

SEQ ID NO: 2457 - RNA, 22 nt, Homo sapiens
cuagcacacagauacgcccaga

SEQ ID NO: 2458 - RNA, 22 nt, Homo sapiens
ugagaaccacgucugcucugag

SEQ ID NO: 2459 - RNA, 22 nt, Homo sapiens
gagcuuauucauaaaagugcag

SEQ ID NO: 2460 - RNA, 25 nt, Homo sapiens
aggcaccagccaggcauugcucagc

SEQ ID NO: 2461 - RNA, 22 nt, Homo sapiens
ugugucacucgaugaccacugu

SEQ ID NO: 2462 - RNA, 23 nt, Homo sapiens
gcggugaucccgauggugugagc

SEQ ID NO: 2463 - RNA, 23 nt, Homo sapiens
uaaaucccauggugccuucuccu

SEQ ID NO: 2464 - RNA, 22 nt, Homo sapiens
ggggguccccggugcucggauc

SEQ ID NO: 2465 - RNA, 22 nt, Homo sapiens
acucaaaacccuucagugacuu

SEQ ID NO: 2466 - RNA, 22 nt, Homo sapiens
gcugggauuacaggcaugagcc

SEQ ID NO: 2467 - RNA, 22 nt, Homo sapiens
uaguaccaguaccuuguguuca

SEQ ID NO: 2468 - RNA, 21 nt, Homo sapiens
agggggaaaguucuauagucc

SEQ ID NO: 2469 - RNA, 22 nt, Homo sapiens
gugagucucuaagaaaagagga

SEQ ID NO: 2470 - RNA, 22 nt, Homo sapiens
augcugacauauuuacuagagg

SEQ ID NO: 2471 - RNA, 21 nt, Homo sapiens
uggguuuacguugggagaacu

SEQ ID NO: 2472 - RNA, 22 nt, Homo sapiens
gucccucuccaaaugugucuug

SEQ ID NO: 2473 - RNA, 22 nt, Homo sapiens
gguucccucuccaaaugugucu

SEQ ID NO: 2474 - RNA, 22 nt, Homo sapiens
ucgggcgcaagagcacugcagu

SEQ ID NO: 2475 - RNA, 24 nt, Homo sapiens
aggagcuauccacuccaggugucc

SEQ ID NO: 2476 - RNA, 22 nt, Homo sapiens
aguugccagggcugccuuuggu

SEQ ID NO: 2477 - RNA, 22 nt, Homo sapiens
agcucuagaaagauuguugacc

SEQ ID NO: 2478 - RNA, 23 nt, Homo sapiens
aggucugcauucaaauccccaga

SEQ ID NO: 2479 - RNA, 21 nt, Homo sapiens
ucuggcugugcuguaaugcag

SEQ ID NO: 2480 - RNA, 22 nt, Homo sapiens
uuggaauaggggauaucucagc

SEQ ID NO: 2481 - RNA, 23 nt, Homo sapiens
acugggaugucacugaauauggu

SEQ ID NO: 2482 - RNA, 21 nt, Homo sapiens
gaagaauaggagggacuuugu

SEQ ID NO: 2483 - RNA, 21 nt, Homo sapiens
ucuagaaaugcaugacccacc

SEQ ID NO: 2484 - RNA, 21 nt, Homo sapiens
auuagguaguggcaguggaac

SEQ ID NO: 2485 - RNA, 22 nt, Homo sapiens
cagcaggggagagagaggaguc

SEQ ID NO: 2486 - RNA, 23 nt, Homo sapiens
caggcagaaguggggcugacagg

SEQ ID NO: 2487 - RNA, 24 nt, Homo sapiens
cugcaggcagaaguggggcugaca

SEQ ID NO: 2488 - RNA, 22 nt, Homo sapiens
uaccauuagaagagcuggaaga

SEQ ID NO: 2489 - RNA, 23 nt, Homo sapiens
uuugggauugacgccacaugucu

SEQ ID NO: 2490 - RNA, 23 nt, Homo sapiens
uauggaguggacuuucagcuggc

SEQ ID NO: 2491 - RNA, 21 nt, Homo sapiens
uuggaggguguggaagacauc

SEQ ID NO: 2492 - RNA, 22 nt, Homo sapiens
uuuaggauaagcuugacuuuug

SEQ ID NO: 2493 - RNA, 22 nt, Homo sapiens
uuugcaguaacaggugugagca

SEQ ID NO: 2494 - RNA, 25 nt, Homo sapiens
caacccuaggagagggugccauuca

SEQ ID NO: 2495 - RNA, 21 nt, Homo sapiens
guguugaaacaaucucuacug

SEQ ID NO: 2496 - RNA, 22 nt, Homo sapiens
uggugggccgcagaacaugugc

SEQ ID NO: 2497 - RNA, 22 nt, Homo sapiens
agagguuauccguguuauguuc

SEQ ID NO: 2498 - RNA, 21 nt, Homo sapiens
agguugccugugagguguuca

SEQ ID NO: 2499 - RNA, 22 nt, Homo sapiens
aggaccuucccugaaccaagga

SEQ ID NO: 2500 - RNA, 22 nt, Homo sapiens
uacccauugcauaucggaguug

SEQ ID NO: 2501 - RNA, 24 nt, Homo sapiens
acuggcuagggaaaaugauuggau

SEQ ID NO: 2502 - RNA, 24 nt, Homo sapiens
ugggcuaagggagaugauugggua

SEQ ID NO: 2503 - RNA, 19 nt, Homo sapiens
ugcgccucgggugagcaug

SEQ ID NO: 2504 - RNA, 20 nt, Homo sapiens
gucccugaguguauguggug

SEQ ID NO: 2505 - RNA, 21 nt, Homo sapiens
acaggcacgacugguuuggca

SEQ ID NO: 2506 - RNA, 23 nt, Homo sapiens
aggaagcccuggaggggcuggag

SEQ ID NO: 2507 - RNA, 20 nt, Homo sapiens
ugggaauggggguaagggcc

SEQ ID NO: 2508 - RNA, 22 nt, Homo sapiens
aggcgauguggggauguagaga

SEQ ID NO: 2509 - RNA, 21 nt, Homo sapiens
uaguggucagagggcuuauga

SEQ ID NO: 2510 - RNA, 23 nt, Homo sapiens
uuccagcccugguaggcgccgcg

SEQ ID NO: 2511 - RNA, 23 nt, Homo sapiens
ugggcaggggcuuauuguaggag

SEQ ID NO: 2512 - RNA, 20 nt, Homo sapiens
aggcgcacccgaccacaugc

SEQ ID NO: 2513 - RNA, 22 nt, Homo sapiens
auaguccgaguaacgucggggc

SEQ ID NO: 2514 - RNA, 23 nt, Homo sapiens
cugggcccgcggcgggcgugggg

SEQ ID NO: 2515 - RNA, 21 nt, Homo sapiens
cgggagcuggggucugcaggu

SEQ ID NO: 2516 - RNA, 23 nt, Homo sapiens
cucggggcaggcggcugggagcg

SEQ ID NO: 2517 - RNA, 23 nt, Homo sapiens
uugggaugguaggaccagagggg

SEQ ID NO: 2518 - RNA, 22 nt, Homo sapiens
ugggcgagggcggcugagcggc

SEQ ID NO: 2519 - RNA, 23 nt, Homo sapiens
agaaagguggagggguugucaga

SEQ ID NO: 2520 - RNA, 22 nt, Homo sapiens
ugggagagcaggguauugugga

SEQ ID NO: 2521 - RNA, 20 nt, Homo sapiens
uaggggguggcaggcuggcc

SEQ ID NO: 2522 - RNA, 22 nt, Homo sapiens
ugggaaagacaaacucagaguu

SEQ ID NO: 2523 - RNA, 23 nt, Homo sapiens
uugaggggagaaugagguggaga

SEQ ID NO: 2524 - RNA, 25 nt, Homo sapiens
cagggcagagggcacaggaaucuga

SEQ ID NO: 2525 - RNA, 21 nt, Homo sapiens
cugggugagggcaucuguggu

SEQ ID NO: 2526 - RNA, 21 nt, Homo sapiens
uugggguggucggcccuggag

SEQ ID NO: 2527 - RNA, 23 nt, Homo sapiens
cgagggguagaagagcacagggg

SEQ ID NO: 2528 - RNA, 22 nt, Homo sapiens
ugggaaagagaaagaacaagua

SEQ ID NO: 2529 - RNA, 22 nt, Homo sapiens
aguuugggauggagagaggaga

SEQ ID NO: 2530 - RNA, 22 nt, Homo sapiens
gugggugcuggugggagccgug

SEQ ID NO: 2531 - RNA, 22 nt, Homo sapiens
aguggggugggacccagcuguu

SEQ ID NO: 2532 - RNA, 22 nt, Homo sapiens
aaggggcagggacggguggccc

SEQ ID NO: 2533 - RNA, 19 nt, Homo sapiens
uggaugacaguggaggccu

SEQ ID NO: 2534 - RNA, 22 nt, Homo sapiens
ccgggagaaggagguggccugg

SEQ ID NO: 2535 - RNA, 24 nt, Homo sapiens
agggguguggaaagaggcagaaca

SEQ ID NO: 2536 - RNA, 22 nt, Homo sapiens
ugugggugggaaggacuggauu

SEQ ID NO: 2537 - RNA, 22 nt, Homo sapiens
ucgggccugggguugggggagc

SEQ ID NO: 2538 - RNA, 24 nt, Homo sapiens
cagggaacagcugggugagcugcu

SEQ ID NO: 2539 - RNA, 23 nt, Homo sapiens
uugggggugagguuggugucugg

SEQ ID NO: 2540 - RNA, 22 nt, Homo sapiens
gggggguguggagccagggggc

SEQ ID NO: 2541 - RNA, 22 nt, Homo sapiens
caccagggcagagcagggcuga

SEQ ID NO: 2542 - RNA, 22 nt, Homo sapiens
ccagggaggcugguuuggagga

SEQ ID NO: 2543 - RNA, 22 nt, Homo sapiens
uaggguagacacugacaacguu

SEQ ID NO: 2544 - RNA, 23 nt, Homo sapiens
uggugcggagagggcccacagug

SEQ ID NO: 2545 - RNA, 23 nt, Homo sapiens
aggguggggcuggagguggggcu

SEQ ID NO: 2546 - RNA, 22 nt, Homo sapiens
uagggaugggaggccaggauga

SEQ ID NO: 2547 - RNA, 23 nt, Homo sapiens
uagagaggggaaggaugugaugu

SEQ ID NO: 2548 - RNA, 22 nt, Homo sapiens
uugugggugggcagaagucugu

SEQ ID NO: 2549 - RNA, 23 nt, Homo sapiens
cagggagaagguggaagugcaga

SEQ ID NO: 2550 - RNA, 21 nt, Homo sapiens
ucugagagagcucgauggcag

SEQ ID NO: 2551 - RNA, 23 nt, Homo sapiens
cggggccauggagcagccugugu

SEQ ID NO: 2552 - RNA, 19 nt, Homo sapiens
cuggggaguggcuggggag

SEQ ID NO: 2553 - RNA, 22 nt, Homo sapiens
ucccagggucuggucagaguug

SEQ ID NO: 2554 - RNA, 25 nt, Homo sapiens
gugaggcggggccaggagggugugu

SEQ ID NO: 2555 - RNA, 21 nt, Homo sapiens
ucuucaaccucaggacuugca

SEQ ID NO: 2556 - RNA, 24 nt, Homo sapiens
cgggugggagcagaucuuauugag

SEQ ID NO: 2557 - RNA, 23 nt, Homo sapiens
ucgcagacagggacacauggaga

SEQ ID NO: 2558 - RNA, 23 nt, Homo sapiens
cacacaggaaaagcggggcccug

SEQ ID NO: 2559 - RNA, 21 nt, Homo sapiens
agguggguauggaggagcccu

SEQ ID NO: 2560 - RNA, 23 nt, Homo sapiens
ugguggguggggaggagaagugc

SEQ ID NO: 2561 - RNA, 24 nt, Homo sapiens
ugagaaggcacagcuugcacguga

SEQ ID NO: 2562 - RNA, 22 nt, Homo sapiens
cucgggagggcaugggccaggc

SEQ ID NO: 2563 - RNA, 22 nt, Homo sapiens
uggguguaggcuggagcugagg

SEQ ID NO: 2564 - RNA, 23 nt, Homo sapiens
uugggcccaggaguaaacaggau

SEQ ID NO: 2565 - RNA, 25 nt, Homo sapiens
acuugggcaggagggacccuguaug

SEQ ID NO: 2566 - RNA, 25 nt, Homo sapiens
ucggggcaugggggagggaggcugg

SEQ ID NO: 2567 - RNA, 19 nt, Homo sapiens
ucugggugcaguggggguu

SEQ ID NO: 2568 - RNA, 23 nt, Homo sapiens
acggggagucaggcaguggugga

SEQ ID NO: 2569 - RNA, 22 nt, Homo sapiens
agugggaggacaggaggcaggu

SEQ ID NO: 2570 - RNA, 21 nt, Homo sapiens
cugggaggggcuggguuuggc

SEQ ID NO: 2571 - RNA, 23 nt, Homo sapiens
uugggagggaagacagcuggaga

SEQ ID NO: 2572 - RNA, 23 nt, Homo sapiens
uggggaaggcuuggcagggaaga

SEQ ID NO: 2573 - RNA, 21 nt, Homo sapiens
cgggccggaggucaagggcgu

SEQ ID NO: 2574 - RNA, 25 nt, Homo sapiens
uaggggugggggaauucaggggugu

SEQ ID NO: 2575 - RNA, 22 nt, Homo sapiens
uaggggaaaaguccugauccgg

SEQ ID NO: 2576 - RNA, 20 nt, Homo sapiens
gccggggcuuugggugaggg

SEQ ID NO: 2577 - RNA, 22 nt, Homo sapiens
ugggagggcguggaugauggug

SEQ ID NO: 2578 - RNA, 21 nt, Homo sapiens
gcgguggggccggaggggcgu

SEQ ID NO: 2579 - RNA, 22 nt, Homo sapiens
uggcggggguagagcuggcugc

SEQ ID NO: 2580 - RNA, 21 nt, Homo sapiens
cugggagaagaguggugaaga

SEQ ID NO: 2581 - RNA, 24 nt, Homo sapiens
guaggggcgucccgggcgcgcggg

SEQ ID NO: 2582 - RNA, 23 nt, Homo sapiens
gugaguguggauuuggcgggguu

SEQ ID NO: 2583 - RNA, 22 nt, Homo sapiens
ccccuggggcugggcaggcgga

SEQ ID NO: 2584 - RNA, 21 nt, Homo sapiens
guaagcaggggcucuggguga

SEQ ID NO: 2585 - RNA, 22 nt, Homo sapiens
uguggguucuggguugggguga

SEQ ID NO: 2586 - RNA, 20 nt, Homo sapiens
cagggggacugggggugagc

SEQ ID NO: 2587 - RNA, 24 nt, Homo sapiens
uggggggacaggaugagaggcugu

SEQ ID NO: 2588 - RNA, 23 nt, Homo sapiens
uugugggguuggagagcuggcug

SEQ ID NO: 2589 - RNA, 25 nt, Homo sapiens
aggagggaaggggcugagaacagga

SEQ ID NO: 2590 - RNA, 23 nt, Homo sapiens
ccagggggaugggcgagcuuggg

SEQ ID NO: 2591 - RNA, 20 nt, Homo sapiens
ggggaggugugcagggcugg

SEQ ID NO: 2592 - RNA, 21 nt, Homo sapiens
guaggugacagucaggggcgg

SEQ ID NO: 2593 - RNA, 23 nt, Homo sapiens
uggucagaggcagcaggaaauga

SEQ ID NO: 2594 - RNA, 20 nt, Homo sapiens
cuagguggggggcuugaagc

SEQ ID NO: 2595 - RNA, 22 nt, Homo sapiens
cuggggguggggggcugggcgu

SEQ ID NO: 2596 - RNA, 21 nt, Homo sapiens
ugagggugucagcaggugacg

SEQ ID NO: 2597 - RNA, 22 nt, Homo sapiens
uagggggcggcuuguggagugu

SEQ ID NO: 2598 - RNA, 24 nt, Homo sapiens
uguaggcaugaggcagggcccagg

SEQ ID NO: 2599 - RNA, 22 nt, Homo sapiens
gugagccaguggaauggagagg

SEQ ID NO: 2600 - RNA, 22 nt, Homo sapiens
caggcagggaggugggaccaug

SEQ ID NO: 2601 - RNA, 22 nt, Homo sapiens
uggcaaggaaagaagaggauca

SEQ ID NO: 2602 - RNA, 23 nt, Homo sapiens
auggggacagggaucagcauggc

SEQ ID NO: 2603 - RNA, 22 nt, Homo sapiens
augcaggccuguguacagcacu

SEQ ID NO: 2604 - RNA, 25 nt, Homo sapiens
auggggugagauggggaggagcagc

SEQ ID NO: 2605 - RNA, 23 nt, Homo sapiens
caggggcugggguuucagguucu

SEQ ID NO: 2606 - RNA, 22 nt, Homo sapiens
ucccaagggugagaugcugcca

SEQ ID NO: 2607 - RNA, 23 nt, Homo sapiens
uagguggcgccggaggagucauu

SEQ ID NO: 2608 - RNA, 21 nt, Homo sapiens
uggggcggggcaggucccugc

SEQ ID NO: 2609 - RNA, 24 nt, Homo sapiens
ucugccauaggaagcuuggagugg

SEQ ID NO: 2610 - RNA, 22 nt, Homo sapiens
uugugugaguacagagagcauc

SEQ ID NO: 2611 - RNA, 22 nt, Homo sapiens
uugggguggagggccaaggagc

SEQ ID NO: 2612 - RNA, 19 nt, Homo sapiens
ugcggcagagcugggguca

SEQ ID NO: 2613 - RNA, 23 nt, Homo sapiens
gugcgugguggcucgaggcgggg

SEQ ID NO: 2614 - RNA, 20 nt, Homo sapiens
cagggaaccaguuggggcuu

SEQ ID NO: 2615 - RNA, 21 nt, Homo sapiens
ucaggguugguagggguugcu

SEQ ID NO: 2616 - RNA, 22 nt, Homo sapiens
guaggggagguugggccaggga

SEQ ID NO: 2617 - RNA, 22 nt, Homo sapiens
uggggagguguggagucagcau

SEQ ID NO: 2618 - RNA, 23 nt, Homo sapiens
ucaauaggaaagaggugggaccu

SEQ ID NO: 2619 - RNA, 22 nt, Homo sapiens
ugggagccaugagggucugugc

SEQ ID NO: 2620 - RNA, 22 nt, Homo sapiens
aggaagcaagagaacccugugg

SEQ ID NO: 2621 - RNA, 20 nt, Homo sapiens
ugggcugcugagaaggggca

SEQ ID NO: 2622 - RNA, 22 nt, Homo sapiens
ccaaggaaggaggcuggacauc

SEQ ID NO: 2623 - RNA, 24 nt, Homo sapiens
uagguagagugugaggaggagguc

SEQ ID NO: 2624 - RNA, 23 nt, Homo sapiens
aguagagaggaaaaguuaggguc

SEQ ID NO: 2625 - RNA, 22 nt, Homo sapiens
guguggaagaugggaggagaaa

SEQ ID NO: 2626 - RNA, 21 nt, Homo sapiens
gugagggacugggauuugugg

SEQ ID NO: 2627 - RNA, 22 nt, Homo sapiens
aggggguagaaaguggcugaag

SEQ ID NO: 2628 - RNA, 22 nt, Homo sapiens
cgcagggcccuggcgcaggcau

SEQ ID NO: 2629 - RNA, 21 nt, Homo sapiens
accagggccagcagggaaugu

SEQ ID NO: 2630 - RNA, 22 nt, Homo sapiens
aagcagcaguggcaagacuccu

SEQ ID NO: 2631 - RNA, 22 nt, Homo sapiens
ucuggauugaagagacgaccca

SEQ ID NO: 2632 - RNA, 24 nt, Homo sapiens
acccccgggcaaagaccugcagau

SEQ ID NO: 2633 - RNA, 22 nt, Homo sapiens
uaggguacucagagcaaguugu

SEQ ID NO: 2634 - RNA, 22 nt, Homo sapiens
uggggguggucucuagccaagg

SEQ ID NO: 2635 - RNA, 19 nt, Homo sapiens
cggggccagagcagagagc

SEQ ID NO: 2636 - RNA, 22 nt, Homo sapiens
ugggggcuggaugggguagagu

SEQ ID NO: 2637 - RNA, 23 nt, Homo sapiens
acagaggacaguggagugugagc

SEQ ID NO: 2638 - RNA, 23 nt, Homo sapiens
ugggggcugggaugggccauggu

SEQ ID NO: 2639 - RNA, 23 nt, Homo sapiens
gaguggauaggggagugugugga

SEQ ID NO: 2640 - RNA, 22 nt, Homo sapiens
gugcggaacgcuggccggggcg

SEQ ID NO: 2641 - RNA, 23 nt, Homo sapiens
aggaggugguacuaggggccagc

SEQ ID NO: 2642 - RNA, 21 nt, Homo sapiens
cccugggguucugaggacaug

SEQ ID NO: 2643 - RNA, 24 nt, Homo sapiens
agcgugggauguccaugaagucag

SEQ ID NO: 2644 - RNA, 24 nt, Homo sapiens
aagcucagguuugagaacugcuga

SEQ ID NO: 2645 - RNA, 25 nt, Homo sapiens
uugggguuuggggugcagacauugc

SEQ ID NO: 2646 - RNA, 24 nt, Homo sapiens
aagagaggagcaguggugcugugg

SEQ ID NO: 2647 - RNA, 22 nt, Homo sapiens
uuggggauugggucaggccagu

SEQ ID NO: 2648 - RNA, 22 nt, Homo sapiens
gugaggaggggcuggcagggac

SEQ ID NO: 2649 - RNA, 23 nt, Homo sapiens
gagaggaacaugggcucaggaca

SEQ ID NO: 2650 - RNA, 22 nt, Homo sapiens
acuggguagguggggcuccagg

SEQ ID NO: 2651 - RNA, 22 nt, Homo sapiens
cgggcaugcugggagagacuuu

SEQ ID NO: 2652 - RNA, 24 nt, Homo sapiens
uugaagggacaagucagauaugcc

SEQ ID NO: 2653 - RNA, 23 nt, Homo sapiens
uagguggcagaggagggacuuca

SEQ ID NO: 2654 - RNA, 23 nt, Homo sapiens
uuagaggcuggaauagagauucu

SEQ ID NO: 2655 - RNA, 23 nt, Homo sapiens
uguguguguagaggaagaaggga

SEQ ID NO: 2656 - RNA, 22 nt, Homo sapiens
acuggcagaacacugaagcagc

SEQ ID NO: 2657 - RNA, 22 nt, Homo sapiens
gugaguaguggcgcgcggcggc

SEQ ID NO: 2658 - RNA, 19 nt, Homo sapiens
ugggggagauggggguuga

SEQ ID NO: 2659 - RNA, 22 nt, Homo sapiens
caugggaguucggggugguugc

SEQ ID NO: 2660 - RNA, 20 nt, Homo sapiens
ucucgcaucaggaggcaagg

SEQ ID NO: 2661 - RNA, 22 nt, Homo sapiens
cagagggaauacagagggcaau

SEQ ID NO: 2662 - RNA, 23 nt, Homo sapiens
auggagcuggaaccagaucaggc

SEQ ID NO: 2663 - RNA, 21 nt, Homo sapiens
ugagggacccaggacaggaga

SEQ ID NO: 2664 - RNA, 22 nt, Homo sapiens
caggaaggagacaggcaguuca

SEQ ID NO: 2665 - RNA, 22 nt, Homo sapiens
agggccgaaggguggaagcugc

SEQ ID NO: 2666 - RNA, 23 nt, Homo sapiens
agggagaaagcuagaagcugaag

SEQ ID NO: 2667 - RNA, 22 nt, Homo sapiens
cagggcagggaaggugggagag

SEQ ID NO: 2668 - RNA, 22 nt, Homo sapiens
ugguggaggaagagggcagcuc

SEQ ID NO: 2669 - RNA, 22 nt, Homo sapiens
ugggguaaggauaggaggguca

SEQ ID NO: 2670 - RNA, 22 nt, Homo sapiens
uacaagucaggagcugaagcag

SEQ ID NO: 2671 - RNA, 22 nt, Homo sapiens
agggagggugugguauggaugu

SEQ ID NO: 2672 - RNA, 22 nt, Homo sapiens
agaggcugagaaggugauguug

SEQ ID NO: 2673 - RNA, 25 nt, Homo sapiens
aggggggcacugcgcaagcaaagcc

SEQ ID NO: 2674 - RNA, 21 nt, Homo sapiens
cccgcaggugagaugagggcu

SEQ ID NO: 2675 - RNA, 23 nt, Homo sapiens
uggggggacagauggagaggaca

SEQ ID NO: 2676 - RNA, 20 nt, Homo sapiens
aaggagaugcucaggcagau

SEQ ID NO: 2677 - RNA, 23 nt, Homo sapiens
ucggggagucugggguccggaau

SEQ ID NO: 2678 - RNA, 21 nt, Homo sapiens
caugggguagggcagaguagg

SEQ ID NO: 2679 - RNA, 19 nt, Homo sapiens
uaaggagggggaugagggg

SEQ ID NO: 2680 - RNA, 21 nt, Homo sapiens
guaagggaccggagaguagga

SEQ ID NO: 2681 - RNA, 21 nt, Homo sapiens
caggcagguguaggguggagc

SEQ ID NO: 2682 - RNA, 24 nt, Homo sapiens
aggaggauggagagcugggccaga

SEQ ID NO: 2683 - RNA, 21 nt, Homo sapiens
cagggccaggcacagaguaag

SEQ ID NO: 2684 - RNA, 23 nt, Homo sapiens
aaggagcuuacaaucuagcuggg

SEQ ID NO: 2685 - RNA, 20 nt, Homo sapiens
ugggaggaggggaucuuggg

SEQ ID NO: 2686 - RNA, 22 nt, Homo sapiens
ucggccuggggaggaggaaggg

SEQ ID NO: 2687 - RNA, 21 nt, Homo sapiens
guguggccggcaggcgggugg

SEQ ID NO: 2688 - RNA, 21 nt, Homo sapiens
cuggggggaggagacccugcu

SEQ ID NO: 2689 - RNA, 21 nt, Homo sapiens
uggggguguggggagagagag

SEQ ID NO: 2690 - RNA, 22 nt, Homo sapiens
ugggggaggaaggacaggccau

SEQ ID NO: 2691 - RNA, 22 nt, Homo sapiens
acgggcagggcagugcacccug

SEQ ID NO: 2692 - RNA, 21 nt, Homo sapiens
uccagggagacagugugugag

SEQ ID NO: 2693 - RNA, 21 nt, Homo sapiens
ucuguggaguggggugccugu

SEQ ID NO: 2694 - RNA, 23 nt, Homo sapiens
gauccaucucugccuguauuggc

SEQ ID NO: 2695 - RNA, 22 nt, Homo sapiens
uuuccuguccuccaaccagacc

SEQ ID NO: 2696 - RNA, 23 nt, Homo sapiens
ugagaacugacaaaugugguagg

SEQ ID NO: 2697 - RNA, 23 nt, Homo sapiens
uucaugaacugggucuagcuugg

SEQ ID NO: 2698 - RNA, 19 nt, Homo sapiens
ucuggggucuugggccauc

SEQ ID NO: 2699 - RNA, 23 nt, Homo sapiens
uuguucucaaacuggcugucaga

SEQ ID NO: 2700 - RNA, 23 nt, Homo sapiens
ucagcauucauuggcaccagaga

SEQ ID NO: 2701 - RNA, 24 nt, Homo sapiens
ggcucaaucucugguccugcagcc

SEQ ID NO: 2702 - RNA, 21 nt, Homo sapiens
uucaacaaggguguaggaugg

SEQ ID NO: 2703 - RNA, 21 nt, Homo sapiens
ugcugagguccgggcugugcc

SEQ ID NO: 2704 - RNA, 23 nt, Homo sapiens
uaaagacuguagaggcaacuggu

SEQ ID NO: 2705 - RNA, 18 nt, Homo sapiens
ugcuuccuuucucagcug

SEQ ID NO: 2706 - RNA, 22 nt, Homo sapiens
ugcggggcuagggcuaacagca

SEQ ID NO: 2707 - RNA, 22 nt, Homo sapiens
gaugguugaccagagagcacac

SEQ ID NO: 2708 - RNA, 23 nt, Homo sapiens
uggaagacuagugauuuuguugu

SEQ ID NO: 2709 - RNA, 22 nt, Homo sapiens
aggaggaauuggugcuggucuu

SEQ ID NO: 2710 - RNA, 23 nt, Homo sapiens
ugcaccaugguugucugagcaug

SEQ ID NO: 2711 - RNA, 22 nt, Homo sapiens
ugagaccucuggguucugagcu

SEQ ID NO: 2712 - RNA, 23 nt, Homo sapiens
uccaguaccacgugucagggcca

SEQ ID NO: 2713 - RNA, 22 nt, Homo sapiens
gagggcagagccagcuuccuga

SEQ ID NO: 2714 - RNA, 22 nt, Homo sapiens
aaaacuaggacuguguggugua

SEQ ID NO: 2715 - RNA, 21 nt, Homo sapiens
aagggacagggagggucgugg

SEQ ID NO: 2716 - RNA, 21 nt, Homo sapiens
guuuggacauaguguggcugg

SEQ ID NO: 2717 - RNA, 21 nt, Homo sapiens
ucaaaugcagauccugacuuc

SEQ ID NO: 2718 - RNA, 22 nt, Homo sapiens
uuggugaggaccccaagcucgg

SEQ ID NO: 2719 - RNA, 21 nt, Homo sapiens
uuuuaaggacacugagggauc

SEQ ID NO: 2720 - RNA, 21 nt, Homo sapiens
gcaggaacuugugagucuccu

SEQ ID NO: 2721 - RNA, 23 nt, Homo sapiens
cggccccacgcaccaggguaaga

SEQ ID NO: 2722 - RNA, 22 nt, Homo sapiens
uauaccucaguuuuaucaggug

SEQ ID NO: 2723 - RNA, 22 nt, Homo sapiens
uggauuucuuugugaaucacca

SEQ ID NO: 2724 - RNA, 20 nt, Homo sapiens
guagaggagauggcgcaggg

SEQ ID NO: 2725 - RNA, 22 nt, Homo sapiens
uccauuacacuacccugccucu

SEQ ID NO: 2726 - RNA, 21 nt, Homo sapiens
cuugggagcccuguuagacuc

SEQ ID NO: 2727 - RNA, 21 nt, Homo sapiens
uacucaaaaagcugucaguca

SEQ ID NO: 2728 - RNA, 22 nt, Homo sapiens
aauggcuguccguaguaugguc

SEQ ID NO: 2729 - RNA, 22 nt, Homo sapiens
ugcaacgaaccugagccacuga

SEQ ID NO: 2730 - RNA, 21 nt, Homo sapiens
uauucagaaaggugccaguca

SEQ ID NO: 2731 - RNA, 23 nt, Homo sapiens
agguugggaucgguugcaaugcu

SEQ ID NO: 2732 - RNA, 22 nt, Homo sapiens
ggguggggauuuguugcauuac

SEQ ID NO: 2733 - RNA, 22 nt, Homo sapiens
agggacgggacgcggugcagug

SEQ ID NO: 2734 - RNA, 23 nt, Homo sapiens
caaagugcuguucgugcagguag

SEQ ID NO: 2735 - RNA, 20 nt, Homo sapiens
gugagucaggguggggcugg

SEQ ID NO: 2736 - RNA, 24 nt, Homo sapiens
uggggagcugaggcucugggggug

SEQ ID NO: 2737 - RNA, 22 nt, Homo sapiens
ucuucucuguuuuggccaugug

SEQ ID NO: 2738 - RNA, 21 nt, Homo sapiens
ucaauaaaugucuguugaauu

SEQ ID NO: 2739 - RNA, 23 nt, Homo sapiens
ucuuugguuaucuagcuguauga

SEQ ID NO: 2740 - RNA, 23 nt, Homo sapiens
uuuggcacuagcacauuuuugcu

SEQ ID NO: 2741 - RNA, 22 nt, Homo sapiens
ugagguaguaaguuguauuguu

SEQ ID NO: 2742 - RNA, 22 nt, Homo sapiens
aacccguagauccgaucuugug

SEQ ID NO: 2743 - RNA, 22 nt, Homo sapiens
cacccguagaaccgaccuugcg

SEQ ID NO: 2744 - RNA, 69 nt, Canis familiaris
ugagguaguagguuguauaguuuggggcucugcccugcucuggguaacuauacaaucuacugucuuucc

SEQ ID NO: 2745 - RNA, 96 nt, Canis familiaris
cugcauguucccagguugagguaguagguuguauaguuuagaauuacaucaagggagauaacuguacagccuccuagcuuuccuugggucuugcac

SEQ ID NO: 2746 - RNA, 85 nt, Canis familiaris
cggggugagguaguagguugugugguuucagggcagugauguugcccccucggaagauaacuauacaaccuacugccuuccccga

SEQ ID NO: 2747 - RNA, 67 nt, Canis familiaris
ugagguaguagguuguaugguuuagaguuacacccugggaguuaacuguacaaccuucuagcuuucc

SEQ ID NO: 2748 - RNA, 67 nt, Canis familiaris
ugagguaggagguuguauaguugaggaggacacccacggagaucacuauacggccuccuagcuuucc

SEQ ID NO: 2749 - RNA, 78 nt, Canis familiaris
ugagguaguagauuguauaguugugggguagugauuuuacccuguucaggagauaacuauacaaucuauugccuuccc

SEQ ID NO: 2750 - RNA, 79 nt, Canis familiaris
ugagguaguaguuuguacaguuugagggucuaugauaccacccgguacaggagauaacuguacaggccacugccuugcc

SEQ ID NO: 2751 - RNA, 68 nt, Canis familiaris
ugagguaguagagugcaguaguuauaaaaggaaucucuggagcuagauugcuguacuucauaccugcu

SEQ ID NO: 2752 - RNA, 59 nt, Canis familiaris
cauacuucuuuauaugcccauauggaccugcuaagcuauggaauguaaagaaguaugua

SEQ ID NO: 2753 - RNA, 59 nt, Canis familiaris
cauacuucuuuauguacccauaugaacauacaaugcuauggaauguaaagaaguaugua

SEQ ID NO: 2754 - RNA, 64 nt, Canis familiaris
uggaagacuagugauuuuguuguuuuuagauaacuaaaucgacaacaaaucacagucugccaua

SEQ ID NO: 2755 - RNA, 62 nt, Canis familiaris
uggaagacuagugauuuuguuguugucucacugcauccaacaacaagucccagucugccaca

SEQ ID NO: 2756 - RNA, 88 nt, Canis familiaris
gagugguuguggucuagugcuguguggaagacuagugauuuuguuguucugauguacuaugacaacaagucacagcuuccucauagcg

SEQ ID NO: 2757 - RNA, 62 nt, Canis familiaris
ucuuugguuaucuagcuguaugagugguguggagucuucauaaagcuagauaaccgaaagua

SEQ ID NO: 2758 - RNA, 60 nt, Canis familiaris
ucuuugguuaucuagcuguaugaguguauuggucuucauaaagcuagauaaccgaaagua

SEQ ID NO: 2759 - RNA, 61 nt, Canis familiaris
ucuuugguuaucuagcuguaugagugccacagagccgucauaaagcuagauaaccgaaagu

SEQ ID NO: 2760 - RNA, 63 nt, Canis familiaris
uacccuguagauccgaauuuguguaaggaauuuuguggucacaaauucguaucuaggggaaua

SEQ ID NO: 2761 - RNA, 101 nt, Canis familiaris
guaacguugucuauauauacccuguagaaccgaauuugugugguauccacauagucacagauucgauucuaggggaauauauggucgaugcaaaaacuuca

SEQ ID NO: 2762 - RNA, 59 nt, Canis familiaris
uagcagcacauaaugguuuguggauuuugaaaaggugcaggccauauugugcugccuca

SEQ ID NO: 2763 - RNA, 60 nt, Canis familiaris
uagcagcacaucaugguuuacauacuacagucaagaugcgaaucauuauuugcugcucua

SEQ ID NO: 2764 - RNA, 65 nt, Canis familiaris
uagcagcacguaaauauuggcguuaagauucuaaaauuaucuccaguauuaacugugcugcugaa

SEQ ID NO: 2765 - RNA, 65 nt, Canis familiaris
uagcagcacguaaauauuggcguagugaaauaaaaauuaaacaccaauauuauugugcugcuuua

SEQ ID NO: 2766 - RNA, 59 nt, Canis familiaris
caaagugcuuacagugcagguagugauaugugcaucuacugcagugaaggcacuuguag

SEQ ID NO: 2767 - RNA, 92 nt, Canis familiaris
gugcuuuuuguucuaaggugcaucuagugcagauagugaaguagauuagcaucuacugcccuaagugcuccuucuggcauaagaaguuaugu

SEQ ID NO: 2768 - RNA, 77 nt, Canis familiaris
ccuguguuaaggugcaucuagugcaguuagugaagccgcuuagaaccuacugcccuaaaugccccuuccggcacagg

SEQ ID NO: 2769 - RNA, 58 nt, Canis familiaris
aguuuugcauaguugcacuacaagaagaauguaguugugcaaaucuaugcaaaacuga

SEQ ID NO: 2770 - RNA, 59 nt, Canis familiaris
guuuugcagguuugcauccagcugugugauauucugcugugcaaauccaugcaaaacug

SEQ ID NO: 2771 - RNA, 64 nt, Canis familiaris
guuuugcagguuugcauuucagcguacuugugcauauagggcugugcaaauccaugcaaaacug

SEQ ID NO: 2772 - RNA, 59 nt, Canis familiaris
uaaagugcuuauagugcagguaguguuucguuaucuacugcauuaugagcacuuaaagu

SEQ ID NO: 2773 - RNA, 68 nt, Canis familiaris
guaccaaagugcucacagugcagguagucugggcuuuucucuacuguagugugggcacuuccgguaac

SEQ ID NO: 2774 - RNA, 60 nt, Canis familiaris
uagcuuaucagacugauguugacuguugaaucucauggcaacagcagucgaugggcuguc

SEQ ID NO: 2775 - RNA, 60 nt, Canis familiaris
aguucuucaguggcaagcuuuauguccugacccagcuaaagcugccaguugaagaacugu

SEQ ID NO: 2776 - RNA, 52 nt, Canis familiaris
guuccuggggaugggauuugcugccugucacaaaucacauugccagggauuu

SEQ ID NO: 2777 - RNA, 54 nt, Canis familiaris
guuccuggcaugcugauuugugacuuaagauuaaaaucacauugccagggauua

SEQ ID NO: 2778 - RNA, 62 nt, Canis familiaris
ggugccuacugagcugauaucaguucucauuguacacacuggcucaguucagcaggaacagg

SEQ ID NO: 2779 - RNA, 62 nt, Canis familiaris
cgugccuacugagcugaaacacaguugauuugugcagacuggcucaguucagcaggaacagg

SEQ ID NO: 2780 - RNA, 59 nt, Canis familiaris
aggcggagacuugggcaauugcuggacgcugcccgcgcauugcacuugucucggucuga

SEQ ID NO: 2781 - RNA, 61 nt, Canis familiaris
uucaaguaauccaggauaggcugugcaggucccaaugggccuauucuugguuacuugcacg

SEQ ID NO: 2782 - RNA, 60 nt, Canis familiaris
uucaaguaauccaggauaggcuguuuccgucugugaggccuauucuugauuacuuguuuc

SEQ ID NO: 2783 - RNA, 56 nt, Canis familiaris
uucaaguaauucaggauagguugugugcuguccagccuguucuccauuacuuggcu

SEQ ID NO: 2784 - RNA, 60 nt, Canis familiaris
gggcuuagcugcuugugagcagaguccacaccaagucguguucacaguggcuaaguuccg

SEQ ID NO: 2785 - RNA, 63 nt, Canis familiaris
agagcuuagcugauuggugaacagugacugguuuccgcuuuguucacaguggcuaaguucugc

SEQ ID NO: 2786 - RNA, 62 nt, Canis familiaris
aaggagcucacagucuauugaguugccuuucugacuuucccacuagauugugagcuccugga

SEQ ID NO: 2787 - RNA, 60 nt, Canis familiaris
acugauuucuuuugguguucagagucaauauaauuuucuagcaccaucugaaaucgguua

SEQ ID NO: 2788 - RNA, 65 nt, Canis familiaris
agcugguuucauauggugguuuagauuuaaauagugauugucuagcaccauuugaaaucaguguu

SEQ ID NO: 2789 - RNA, 66 nt, Canis familiaris
agcugguuucacaugguggcuuagauuuuuccaucuuuguaucuagcaccauuugaaaucaguguu

SEQ ID NO: 2790 - RNA, 58 nt, Canis familiaris
accgauuucuccugguguucagagucuguuuuugucuagcaccauuugaaaucgguua

SEQ ID NO: 2791 - RNA, 58 nt, Canis familiaris; identical to SEQ ID NO: 2790

SEQ ID NO: 2792 - RNA, 63 nt, Canis familiaris
uguaaacauccucgacuggaagcugugaagccacagaugggcuuucagucggauguuugcagc

SEQ ID NO: 2793 - RNA, 60 nt, Canis familiaris
uguaaacauccuacacucagcuguaguacauggauuggcugggagguggauguuuacuuc

SEQ ID NO: 2794 - RNA, 61 nt, Canis familiaris
uguaaacauccuacacucucagcugugagcucaagguggcugggagaggguuguuuacucc

SEQ ID NO: 2795 - RNA, 62 nt, Canis familiaris
uguaaacauccuacacucucagcuguggaaaguaagaaagcugggagaaggcuguuuacucu

SEQ ID NO: 2796 - RNA, 60 nt, Canis familiaris
uguaaacauccccgacuggaagcuggaagacagcaaagcuuucagucagauguuugcugc

SEQ ID NO: 2797 - RNA, 64 nt, Canis familiaris
uguaaacauccuugacuggaagcuguaaggugcucagaggggcuuucagucggauguuuacagc

SEQ ID NO: 2798 - RNA, 59 nt, Canis familiaris
aggcaagaugcuggcauagcuguugaacugagaaccugcuaugccaacauauugccauc

SEQ ID NO: 2799 - RNA, 62 nt, Canis familiaris
uauugcacauuacuaaguugcauguugucacggccucaaugcaauuuagugugugugauauu

SEQ ID NO: 2800 - RNA, 61 nt, Canis familiaris
gugcauuguaguugcauugcauguucuggcgguacccgugcaauguuuccacagugcauca

SEQ ID NO: 2801 - RNA, 94 nt, Canis familiaris
gcgggcggccccgcggugcauugcuguugcauugcacgugagugacgcgggugcagugccucggcagugcagcccggagccggccccuggcacc

SEQ ID NO: 2802 - RNA, 66 nt, Canis familiaris
uggcagugucuuagcugguuguugugaguaauagugaaggaagcaaucagcaaguauacugcccua

SEQ ID NO: 2803 - RNA, 84 nt, Canis familiaris
gugcucgguuuguaggcaguguaauuagcugauuguccucugcugcuuacaaucacuaacuccacugccaucaaaacaaggcac

SEQ ID NO: 2804 - RNA, 55 nt, Canis familiaris
aggcaguguaguuagcugauugcuaauaguaccaaucacuaaccacacggccagg

SEQ ID NO: 2805 - RNA, 59 nt, Canis familiaris
agguugggaucgguugcaaugcuguguuucuguaugguauugcacuugucccggccugu

SEQ ID NO: 2806 - RNA, 61 nt, Canis familiaris
ggguggggauuuguggcauuacuuguguuccauauaaaguauugcacuugucccggccugu

SEQ ID NO: 2807 - RNA, 63 nt, Canis familiaris
agggacgggacgcggugcaguguuguucucucccccgccaauauugcacucgucccggccucc

SEQ ID NO: 2808 - RNA, 61 nt, Canis familiaris
caaagugcuguucgugcagguagugugauuaccugaccuacugcugagcuagcacuucccg

SEQ ID NO: 2809 - RNA, 81 nt, Canis familiaris
aacacaguggacgcucaauaaauguuuguugaauugagaugcauuaaauucaacggguauuuauugagcacccacucugug

SEQ ID NO: 2810 - RNA, 89 nt, Canis familiaris
cugcuuggccgauuuuggcacuagcacauuuuugcuugugucucuccgcucugagcaaucaugugcagugccaauaugggaaaagcggg

SEQ ID NO: 2811 - RNA, 80 nt, Canis familiaris
ugagguaguaaguuguauuguugugggguagggauuuuaggccccaauuagaagauaacuauacaacuuacuacuuuccc

SEQ ID NO: 2812 - RNA, 59 nt, Canis familiaris
aacccguagauccgaucuuguggugaaguggacggcacaagcucgcuucuaugggucug

SEQ ID NO: 2813 - RNA, 57 nt, Canis familiaris
aacccguagauccgaucuuguggugauaguccacacaagcuugugucuauagguaug

SEQ ID NO: 2814 - RNA, 60 nt, Canis familiaris
cacccguagaaccgaccuugcggggccuucgccgcacacaagcucgagucugugggucug

SEQ ID NO: 2815 - RNA, 55 nt, Canis familiaris
aguuaucacagugcugaugcuguccauucuaaagguacaguacugugauaacuga

SEQ ID NO: 2816 - RNA, 55 nt, Canis familiaris
gguuaucaugguaccgaugcuguauaucugaaagguacaguacugugauaacuga

SEQ ID NO: 2817 - RNA, 62 nt, Canis familiaris
ucggcuucuuuacagugcugccuuguugcauauggaucaagcagcauuguacagggcuauga

SEQ ID NO: 2818 - RNA, 77 nt, Canis familiaris
uugugcuuucagcuucuuuacagugcugccuuguagcauucaggucaagcagcauuguacagggcuaugaaagaacc

SEQ ID NO: 2819 - RNA, 81 nt, Canis familiaris
ugugcaucguagucaaaugcucagacuccugugguggcugcucaugcaccacggauguuugagcaugugcuacggugucua

SEQ ID NO: 2820 - RNA, 80 nt, Canis familiaris
ugugcaucauggucaaaugcucagacuccuugguggcugcuuaugcaccaugaauguuugagcaugugcuauggugucua

SEQ ID NO: 2821 - RNA, 57 nt, Canis familiaris
aaagugcuuacagugcagguagcauucugcgaucuacugcaaugcaagcacuucuua

SEQ ID NO: 2822 - RNA, 59 nt, Canis familiaris
uaaagugcugacagugcagauagcgguccuccgugcuaccgcacuguggguacuugcug

SEQ ID NO: 2823 - RNA, 58 nt, Canis familiaris
agcuucuuuacaguguugccuuguggcauggaguucaagcagcauuguacagggcuau

SEQ ID NO: 2824 - RNA, 58 nt, Canis familiaris
uggagugugacaaugguguuuguguccaaacuaucaaacgccauuaucacacuaaaua

SEQ ID NO: 2825 - RNA, 59 nt, Canis familiaris
guguucacagcggaccuugauuuaaauguccauacaauuaaggcacgcggugaaugcca

SEQ ID NO: 2826 - RNA, 57 nt, Canis familiaris
guguucacagcggaccuugauuuaaugucauacaauuaaggcacgcggugaaugcca

SEQ ID NO: 2827 - RNA, 58 nt, Canis familiaris
guguucacagcggaccuugauuuaauguccauacaauuaaggcacgcggugaaugcca

SEQ ID NO: 2828 - RNA, 60 nt, Canis familiaris
ucccugagacccuuuaaccugugaggacauccagggucacaggugagguucuugggagcc

SEQ ID NO: 2829 - RNA, 61 nt, Canis familiaris
ucccugagacccuaacuugugauguuuaccguuuaaauccacggguuaggcucuugggagc

SEQ ID NO: 2830 - RNA, 61 nt, Canis familiaris
ucccugagacccuaacuugugagguauuuuaguaacaucacaagucaggcucuugggaccu

SEQ ID NO: 2831 - RNA, 59 nt, Canis familiaris
cauuauuacuuuugguacgcgcugugacacuucaaacucguaccgugaguaauaaugcg

SEQ ID NO: 2832 - RNA, 60 nt, Canis familiaris
ccugcugaagcucagagggcucugauucagaaagaucaucggauccgucugagcuuggcu

SEQ ID NO: 2833 - RNA, 56 nt, Canis familiaris
cggggccguagcacugucugagagguuuacauuucucacagugaaccggucucuuu

SEQ ID NO: 2834 - RNA, 58 nt, Canis familiaris
gggggccgauacacuguacgagagugaguagcaggucucacagugaaccggucucuuu

SEQ ID NO: 2835 - RNA, 65 nt, Canis familiaris
cuuuuugcggucugggcuugcuguuccucucaacaguagucaggaagcccuuaccccaaaaagua

SEQ ID NO: 2836 - RNA, 63 nt, Canis familiaris
cuuuuugcggucugggcuugcuguacauaacucgauagccggaagcccuuaccccaaaaagca

SEQ ID NO: 2837 - RNA, 62 nt, Canis familiaris
gcucuuuucacauugugcuacugucugcaccuaccacuagcagugcaauguuaaaagggcau

SEQ ID NO: 2838 - RNA, 60 nt, Canis familiaris
acucuuucccuguugcacuacugugggccgcugggaagcagugcaaugaugaaagggcau

SEQ ID NO: 2839 - RNA, 60 nt, Canis familiaris
aaccguggcuuucgauuguuacugugggaaccggagguaacagucuacagccauggucgc

SEQ ID NO: 2840 - RNA, 87 nt, Canis familiaris
caaugcuuugcuagagcugguaaaauggaaccaaaucgccucuucaauggauuugguccccuucaaccagcuguagcuaugcauuga

SEQ ID NO: 2841 - RNA, 84 nt, Canis familiaris
cccugcucuggcuggucaaacggaaccaaguccgucuuccugagagguuugguccccuucaaccagcuacagcagggcuggcaa

SEQ ID NO: 2842 - RNA, 86 nt, Canis familiaris
aaugcuuugcuaaagcugguaaaauggaaccaaaucaacuguucaauggauuugguccccuucaaccagcuguagcugugcauuga

SEQ ID NO: 2843 - RNA, 73 nt, Canis familiaris
cagggugugugacugguugaccagaggggcaagcacucuguucacccugugggccaccuagucaccaacccuc

SEQ ID NO: 2844 - RNA, 87 nt, Canis familiaris
aggccucgcuguucucuauggcuuuuuauuccuaugugauuuuacugcucacucauauagggauuggagccguggcguacggcgggg

SEQ ID NO: 2845 - RNA, 62 nt, Canis familiaris
uuauggcuuuuuauuccuaugugauaguaauaaagucucauguagggauggaagccaugaaa

SEQ ID NO: 2846 - RNA, 89 nt, Canis familiaris
gcucugcuguggccuauggcuuuucauuccuaugugauugcuguuucuaauucauguagggcuaaaagccaugggcuacagugaggggc

SEQ ID NO: 2847 - RNA, 56 nt, Canis familiaris
acuccauuuguuuugaugauggauucuuacgcuccaucaucgucucaaaugagucu

SEQ ID NO: 2848 - RNA, 55 nt, Canis familiaris
ggguauucuuggguggauaauacggauuacguuguuauugcuuaagaauacgcgu

SEQ ID NO: 2849 - RNA, 62 nt, Canis familiaris
agcugguguugugaaucaggccguugccaaucagagaacggcuacuucacaacaccaggguc

SEQ ID NO: 2850 - RNA, 69 nt, Canis familiaris
agcugguguugugaaucaugccgacgagcagcgcauccucuuacccggcuauuucacgacaccaggguu

SEQ ID NO: 2851 - RNA, 57 nt, Canis familiaris
cuacagugcacgugucuccaguguggcuccgaggcuggagacgcggcccuguuggaa

SEQ ID NO: 2852 - RNA, 61 nt, Canis familiaris
cagugguuuuacccuaugguagguuacgucaugcuguucuaccacaggguagaaccacgga

SEQ ID NO: 2853 - RNA, 86 nt, Canis familiaris
gccggcucuggguccaucuuccaguacaguguuggauggucuagucacgaagcuccuaacacugucugguaaagauggcccccggg

SEQ ID NO: 2854 - RNA, 63 nt, Canis familiaris
cccauaaaguagaaagcacuacuaacagcacuggaggguguaguguuuccuacuuuauggaug

SEQ ID NO: 2855 - RNA, 55 nt, Canis familiaris
ggugcagugcugcaucucuggucaguugggagucugagaugaagcacuguagcuc

SEQ ID NO: 2856 - RNA, 60 nt, Canis familiaris
aggauaucaucauauacuguaaguuugcgacaagauacuacaguauagaugauguacuag

SEQ ID NO: 2857 - RNA, 83 nt, Canis familiaris
uguccucacgguccaguuuucccaggaaucccuuagaugcuaagauggggauuccuggaaauacuguucuugaggucaugguu

SEQ ID NO: 2858 - RNA, 58 nt, Canis familiaris
ugagaacugaauuccauggguugugucagugucagaccugugaaguucaguucuucag

SEQ ID NO: 2859 - RNA, 61 nt, Canis familiaris
ugagaacugaauuccauaggcugugagcuugagcaaacagccuagggacucaguucuggug

SEQ ID NO: 2860 - RNA, 86 nt, Canis familiaris
acucuaugaaucuaguggaaacauugcugcacaaacuagauuauggauaccagugugcggaaaugcuucugcuacauuuuuagggc

SEQ ID NO: 2861 - RNA, 60 nt, Canis familiaris
aaaguucugagacacuccgacucugaauaugauagaagucagugcacuacagaacuuugu

SEQ ID NO: 2862 - RNA, 61 nt, Canis familiaris
gaaguucuguuauacacucaggcuguggcucucugaaagucagugcaucacagaacuuugu

SEQ ID NO: 2863 - RNA, 83 nt, Canis familiaris
gccggcgcccgggcucuggcuccgugucuucacucccguguguccgaggagggagggagggacgggggcugugcuggggcagc

SEQ ID NO: 2864 - RNA, 57 nt, Canis familiaris
ucucccaacccuuguaccagugcugugccucagucccugguacaggcauggggggca

SEQ ID NO: 2865 - RNA, 56 nt, Canis familiaris
ucgaggagcucacagucuaguaugucucagcccuacuagacugaggcuccuugagg

SEQ ID NO: 2866 - RNA, 59 nt, Canis familiaris
agguucugugauacacuccgacucgggcucuggagcagucagugcaugacagaacuugg

SEQ ID NO: 2867 - RNA, 80 nt, Canis familiaris
agcgguggccagugucauuuuugugauguugcagcuaguaauaugagcccaguugcauagucacaaaagugaucauugga

SEQ ID NO: 2868 - RNA, 61 nt, Canis familiaris
uuaaugcuaaucgugauagggguuuuuaccuccgacugacuccuacauguuagcauuaaca

SEQ ID NO: 2869 - RNA, 62 nt, Canis familiaris
aacauucaacgcugucggugaguuuggaauuaaaaucaaaaccaucgaccguugauuguacc

SEQ ID NO: 2870 - RNA, 60 nt, Canis familiaris
aacauucaacgcugucggugaguuugggauuugaaaaaaccaccgaccguugacuguacc

SEQ ID NO: 2871 - RNA, 62 nt, Canis familiaris
aacauucauugcugucgguggguugaacuguguggacaagcucacugaacaaugaaugcaac

SEQ ID NO: 2872 - RNA, 60 nt, Canis familiaris
aacauucauugcugucgguggguuugagucugaaucaacucacugaucaaugaaugcaaa

SEQ ID NO: 2873 - RNA, 61 nt, Canis familiaris
aacauucaaccugucggugaguuugggcagcucaggcaaaccaucgaccguugaguggacc

SEQ ID NO: 2874 - RNA, 64 nt, Canis familiaris
aacauucauuguugucgguggguugugaggacggaggccagacccaccgagggaugaaugucac

SEQ ID NO: 2875 - RNA, 92 nt, Canis familiaris
gcuugccucccgccguuuuuggcaaugguagaacucacacuggugagguaaugggauccggugguucuagacuugccaacuauggugcgagg

SEQ ID NO: 2876 - RNA, 62 nt, Canis familiaris
uauggcacugguagaauucacugugaacagucucggucagugaauuaccgaagggccauaaa

SEQ ID NO: 2877 - RNA, 68 nt, Canis familiaris
ccccuuaucacuuuuccagccagcuuugugacucuaaguguuggacggagaacugauaaggguaggug

SEQ ID NO: 2878 - RNA, 56 nt, Canis familiaris
uggagagaaaggcaguuccugaugguccccuccccaggggcuggcuuuccucuggu

SEQ ID NO: 2879 - RNA, 61 nt, Canis familiaris
caaagaauucuccuuuugggcuuucugauuuuauuuuaagcccaaaggugaauuuuuuggg

SEQ ID NO: 2880 - RNA, 68 nt, Canis familiaris
cucgggcuacaacacgggacccgggcgcugcuccgaccccucgugucuuguguugcagccggagggac

SEQ ID NO: 2881 - RNA, 86 nt, Canis familiaris
ugcucccucucucacaucccuugcaugguggagggugagcuuuuugaaaaccccucccacaugcaggguuugcaggauggugagcc

SEQ ID NO: 2882 - RNA, 85 nt, Canis familiaris; identical to SEQ ID NO: 97

SEQ ID NO: 2883 - RNA, 78 nt, Canis familiaris
ugcuucugugugauauguuugauauuggguuguuuaauuaggaaucaacuaaauaucgaacauauucuuacagcagug

SEQ ID NO: 2884 - RNA, 64 nt, Canis familiaris
caacggaaucccaaaagcagcuguugucuccagagcauuccagcugcgcuuggauuucguuccc

SEQ ID NO: 2885 - RNA, 65 nt, Canis familiaris
cugaccuaugaauugacagccagugcucucaucucuccucuggcugccaauuccauaggucacag

SEQ ID NO: 2886 - RNA, 56 nt, Canis familiaris
ugggucuuugcgggcgagaugagggugucgguucaacuggccuacaaagucccagu

SEQ ID NO: 2887 - RNA, 59 nt, Canis familiaris
cgggguuuugagggcgagaugaguuuauguuugauccaacuggcccacaaagucccgcu

SEQ ID NO: 2888 - RNA, 58 nt, Canis familiaris
uguaacagcaacuccauguggauugugugccaauuuccaguggagaugcuguuacuuu

SEQ ID NO: 2889 - RNA, 61 nt, Canis familiaris
uagcagcacagaaauauuggcacugggaagagagucugccaauauuggcugugcugcucua

SEQ ID NO: 2890 - RNA, 91 nt, Canis familiaris
acugcugagugaauuagguaguuucauguuguugggccuggauuucugaacacaacaacauuaaaccacccgacucacggcaguuacugcu

SEQ ID NO: 2891 - RNA, 59 nt, Canis familiaris
uagguaguuucauguuguugggauugaguuuugaacucggcaacaagaaacugccugag

SEQ ID NO: 2892 - RNA, 58 nt, Canis familiaris
uagguaguuuccuguuguugggauccaccuuucucucgacagcacgacacugccuuca

SEQ ID NO: 2893 - RNA, 61 nt, Canis familiaris
cggguagagagggcagugggagguaagagcucuucacccuucaccaccuucuccacccagc

SEQ ID NO: 2894 - RNA, 61 nt, Canis familiaris
ccaguguucagacuaccuguucagggggcucugaauguguacaguagucugcacauugguu

SEQ ID NO: 2895 - RNA, 59 nt, Canis familiaris
ccaguguucagacuaccuguucaggacaaugccguuguacaguagucugcacauugguu

SEQ ID NO: 2896 - RNA, 59 nt, Canis familiaris
ccaguguuuagacuaucuguucaggacucccaaauuguacaguagucugcacauugguu

SEQ ID NO: 2897 - RNA, 90 nt, Canis familiaris
cugggccucugugggcaucuuaccggacagugcuggauuucuuggcuugacucuaacacugucugguaacgauguucaaaggugacccac

SEQ ID NO: 2898 - RNA, 80 nt, Canis familiaris
gccaucgccaucuuacugggcagcauuggauggugucaggucucuaauacugccugguaaugaugacggcggggcccugc

SEQ ID NO: 2899 - RNA, 63 nt, Canis familiaris
cgucuuacccagcaguguuugggugcugguugggagucucuaauacugccggguaaugaugga

SEQ ID NO: 2900 - RNA, 71 nt, Canis familiaris
guuccuuuuuccuaugcauauacuucuuugagggucuggccugaagagguguaaggcaugggaaaaggggg

SEQ ID NO: 2901 - RNA, 94 nt, Canis familiaris
cccggcgcgcuggguccagugguucuuaacaguucaacaguucuguagcgcaauugugaaauguuuaggaccacuagccccggcgggcccggcg

SEQ ID NO: 2902 - RNA, 60 nt, Canis familiaris
uucccuuugucauccuaugccugagaauauaugaaggaggcugggaaggcaaagggacgu

SEQ ID NO: 2903 - RNA, 69 nt, Canis familiaris
cucuuguccuucauuccaccggagucugucucguacccaaccagauuucaguggagugaaguucaggag

SEQ ID NO: 2904 - RNA, 60 nt, Canis familiaris
acaugcuucuuuauauccccauacggauuacguugcuauggaauguaaggaagugugugg

SEQ ID NO: 2905 - RNA, 69 nt, Canis familiaris
caggggcgaggggcugcggggggagcggggcggaggcugcggccgcuucuccggucucuccuccuuccc

SEQ ID NO: 2906 - RNA, 69 nt, Canis familiaris
acgcaugagcuuuuggcucggguuauaccugaugcucacguauaagacgagcaaaaagcuuguugguca

SEQ ID NO: 2907 - RNA, 74 nt, Canis familiaris
ccucucagggaagcuuuuugcucgcguuauguuucucauccgaauauaagacgaacaaaagguuugucugaggg

SEQ ID NO: 2908 - RNA, 98 nt, Canis familiaris
ccuccaggcgcagggcagccacugcccaucgcacacugcgcugcuccggacccacugugcgugugacagcggcugaucugucccugggcagcgcgacc

SEQ ID NO: 2909 - RNA, 100 nt, Canis familiaris
cuggccaugugacuugugggcuucccuuugucauccuuugccuaggguucugagaggggcagggacagcaaaggggugcucaguugucaccucucacagc

SEQ ID NO: 2910 - RNA, 62 nt, Canis familiaris
accuuggcucuagacugcuuacugcccgggccgcccucaguaacagucuccagucacggcca

SEQ ID NO: 2911 - RNA, 110 nt, Canis familiaris
ggccuggcuggacggaguugucaugugucugccugucuacacuugcugugcagaacauccgcucaccuguacagcaggcacagacaggcagucacaugacaacccagccu

SEQ ID NO: 2912 - RNA, 79 nt, Canis familiaris
uguacaggaaaaugaccuacgaauugauagacaauuuggcuaaguuugucugucauuuuuguaggccaauauucuguau

SEQ ID NO: 2913 - RNA, 105 nt, Canis familiaris
gauggcugugaguuggcuuaaucucagcuggcaacugugagauguucauacaaucccccacaguggucucugggauuaugcuaaacagagcaauauccuugcccu

SEQ ID NO: 2914 - RNA, 62 nt, Canis familiaris
aaaucucugcaggcaaaugugaugucacuaaagaaaucacacacuuacccguagagauucug

SEQ ID NO: 2915 - RNA, 82 nt, Canis familiaris
uugaugucgcagauacugcaucaggaacugauuggauaagaaugggucaccaucaguuccuaaugcauugccuucagcaucu

SEQ ID NO: 2916 - RNA, 64 nt, Canis familiaris
uugugcuugaucuaaccaugugguugccagguaugaguaaaacaugguuccgucaagcaccaug

SEQ ID NO: 2917 - RNA, 64 nt, Canis familiaris
uugugcuugaucuaaccaugugguggaacgauggaaacggaacaugguucugucaagcaccgcg

SEQ ID NO: 2918 - RNA, 63 nt, Canis familiaris
ugauuguccaaacgcaauucucgagucucuggcucuggccgagaguugagucuggacgucccg

SEQ ID NO: 2919 - RNA, 65 nt, Canis familiaris
ugauuguccaaacgcaauucuuguacgagucugcggccaaccgagaauuguggcuggacaucugu

SEQ ID NO: 2920 - RNA, 62 nt, Canis familiaris
accuggcauacaauguagauuucuguguuuguugggcaacagcuacauugucugcuggguuu

SEQ ID NO: 2921 - RNA, 90 nt, Canis familiaris
cccucaauggcucaguagccaguguagauccugucuuuuguaaucaguagcuacaucuggcuacugggucucugauggcaucuucuagcu

SEQ ID NO: 2922 - RNA, 103 nt, Canis familiaris
ccuggccuccugcagugccacacuccguguauuugacaagcugaguuagacacuccauguggaagagugucaguuugucaaauaccccaagugcggcacaugc

SEQ ID NO: 2923 - RNA, 69 nt, Canis familiaris
caagucacuagugguuccguuuaguagaugauuaugcauuguuucaaaauggugcccuagugacugcaa

SEQ ID NO: 2924 - RNA, 63 nt, Canis familiaris
aagaaaugguuuaccgucccacauacauuuugaguauguaugugggacgguaaaccgcuucuu

SEQ ID NO: 2925 - RNA, 78 nt, Canis familiaris
gcuacuugaagagagguuauccuucguguguuuguaugauuguaaugaauaugcaaggacaagcucucuccgaggagc

SEQ ID NO: 2926 - RNA, 84 nt, Canis familiaris
cugcuaacgaaugcucugacuuuauugcacuacuguacuuuacagcuagcagugcaauaguauugucaaagcaucugaaagcag

SEQ ID NO: 2927 - RNA, 76 nt, Canis familiaris
cccaggugcucugacgagguugcacuacugugcucugagaagcagugcaaugauauugucaaagcaucggggacca

SEQ ID NO: 2928 - RNA, 69 nt, Canis familiaris
ccaccacuuaaacguggauguacuugcuuugaaacucaaaaaguaagugcuuccauguuuuagugaugg

SEQ ID NO: 2929 - RNA, 75 nt, Canis familiaris
cucccuuuaacuuuaacauggaaguacuuucuuugacuuucaaaauaguaagugcuuccauguuuuaguagaagu

SEQ ID NO: 2930 - RNA, 68 nt, Canis familiaris
ccuuugcuuuaacauggggguaccugcuguguaaaacaaaaguaagugcuuccauguuucaguggagg

SEQ ID NO: 2931 - RNA, 70 nt, Canis familiaris
ccucuacuuuaacauggaggcacuugcugugacaugauaaaaauaagugcuuccauguuuuaguguggug

SEQ ID NO: 2932 - RNA, 54 nt, Canis familiaris
gccuucucuucccgguucuucccggagucgggaaaagcuggguugagagggcga

SEQ ID NO: 2933 - RNA, 56 nt, Canis familiaris
aggugguccguggcgcguucgcuuuauuuauggcgcacauuacacggucgaccucu

SEQ ID NO: 2934 - RNA, 68 nt, Canis familiaris
cgcauccccuagggcauugguguggagcuggagacccacugccccaggugcugcuggggguuguaguc

SEQ ID NO: 2935 - RNA, 94 nt, Canis familiaris
agugcuugguuccuaguagguguucaguaaguguuugugacauaauucguuuauugagcaccuccuaucaaucaagcacugugcuaggcucugg

SEQ ID NO: 2936 - RNA, 91 nt, Canis familiaris
ucugucuguugggcuggaggcagggccuuugugaaggcggguggugaucggaucgccucugggcccuuccuccagcccagaggcggauuca

SEQ ID NO: 2937 - RNA, 63 nt, Canis familiaris
aggggggcaggaagggcucagggagaaagugugugcagccccuggcccucucugcccuuccgu

SEQ ID NO: 2938 - RNA, 60 nt, Canis familiaris
agagguuuucuggguuucuguuucuuucaugaggaugaaacacacccaguuaaccucuuu

SEQ ID NO: 2939 - RNA, 80 nt, Canis familiaris
gguaccugaagagagguuuucuggguuucuguuucuuuaaugaggaugaaacacaccugguuaaccucuuuuccaguauc

SEQ ID NO: 2940 - RNA, 89 nt, Canis familiaris
cuuuggcgaucacugccucucugggccugugucuuaggcucugcaagaucaaccgagcaaagcacacggccugcagagaggcagcgcuc

SEQ ID NO: 2941 - RNA, 90 nt, Canis familiaris
gaguuugguuuuguuuggguuuguucuagguauggucccagggaucccagaucaaaccaggccccugggccuauccuagaaccaaccuaa

SEQ ID NO: 2942 - RNA, 58 nt, Canis familiaris
ucaagagcaauaacgaaaaauguuugucauaaaccguuuuucauuauugcuccugacc

SEQ ID NO: 2943 - RNA, 59 nt, Canis familiaris
aacaauauccuggugcugagugaugacacaugcaacuccagcaucagugauuuuguuga

SEQ ID NO: 2944 - RNA, 92 nt, Canis familiaris
uuguaccugaugcgauuauaaagcaaugagacugauugucaugugucgguugugggauccgucucaguuacuuuauagccgugccugguacc

SEQ ID NO: 2945 - RNA, 63 nt, Canis familiaris
gggugcuaucugugauugagggacauggcaaauagaauugucucacacagaaaucgcacccgu

SEQ ID NO: 2946 - RNA, 60 nt, Canis familiaris
ugcugacucuuaguccagugcucgugauggcuggugggcccugaacuaggggucuggagg

SEQ ID NO: 2947 - RNA, 95 nt, Canis familiaris
ggucucuguggugggcgucugucugcccgcaugccugccucuuuguugcucggaaggaggcaggggcugggccugcagcugccugggcagagcgg

SEQ ID NO: 2948 - RNA, 57 nt, Canis familiaris
agugcacgcgcuuugggacagugaagaaaauaauguucacaaagcccauacacuuuu

SEQ ID NO: 2949 - RNA, 63 nt, Canis familiaris
uuaucagaaucuccagggguacuuaaaauuugaaaaagucccccaggugugauucugauuugc

SEQ ID NO: 2950 - RNA, 68 nt, Canis familiaris
gaauccuuggaaccuaggugugagugcuauuucggugcaacacaccuauucaaggauucaaagaggcu

SEQ ID NO: 2951 - RNA, 67 nt, Canis familiaris
ucggguggaucacgaugcaauuuugaugaguauaauaggagaaaaauugcacgguauccaucuguaa

SEQ ID NO: 2952 - RNA, 87 nt, Canis familiaris; identical to SEQ ID NO: 220

SEQ ID NO: 2953 - RNA, 111 nt, Canis familiaris; identical to SEQ ID NO: 221

SEQ ID NO: 2954 - RNA, 68 nt, Canis familiaris
ccaugacuguugcuaauaugcaacucuguucaauacaaauuggaauugcacuuuagcaauggugaugg

SEQ ID NO: 2955 - RNA, 56 nt, Canis familiaris
aguucgaccguguuauauucgcuuuauugacuucgaauaauacaugguuggucuuu

SEQ ID NO: 2956 - RNA, 79 nt, Canis familiaris
agacagagaggccaggucacgucucugcaguuacacagcucaugagugccugcugggguggaaccuggucugucugucu

SEQ ID NO: 2957 - RNA, 60 nt, Canis familiaris
acucaaaaaauggcggcacuuuccuaccuagaacagaaagugcccccacaguuugagugg

SEQ ID NO: 2958 - RNA, 52 nt, Canis familiaris
uuauaauacaaccugauaaguguuguagcacuuaccagguuguauuguaauu

SEQ ID NO: 2959 - RNA, 52 nt, Canis familiaris
auauaauacaaccugcuaaguguccuagcacuuaucagguuguauuaucauu

SEQ ID NO: 2960 - RNA, 70 nt, Canis familiaris
gccccgcgacgagccccucgcacaaaccggaccugagcguuuuguucguucggcucgcgugaggcagggg

SEQ ID NO: 2961 - RNA, 58 nt, Canis familiaris
guagauucuccuucuaugaguacauuauuuaugauuaaucauagaggaaaauccacgu

SEQ ID NO: 2962 - RNA, 58 nt, Canis familiaris
guagauuuuccuucuaugauuacguguuugaugguuaaucauagaggaaaauccacgu

SEQ ID NO: 2963 - RNA, 59 nt, Canis familiaris
gguggauguuccuucuauguuuacgggauuuauaguuaaucauagaggaaaauccacgu

SEQ ID NO: 2964 - RNA, 99 nt, Canis familiaris
agucuuucuuugguauuuaaaagguggauauuccuucuauguuuacgugauucauagauaaucauagaggaaaauccauguuuucaguaucaaaugcug

SEQ ID NO: 2965 - RNA, 86 nt, Canis familiaris
uuugguauuuaaaagguggauauuccuucuauguuuauguuauuuaugguuaaacauagaggaaauuccacguuuucaguaucaaa

SEQ ID NO: 2966 - RNA, 69 nt, Canis familiaris; identical to SEQ ID NO: 237

SEQ ID NO: 2967 - RNA, 60 nt, Canis familiaris
cuccugacuccagguccuguguguuaccucgaaauagcacuggacuuggagucagaaggc

SEQ ID NO: 2968 - RNA, 59 nt, Canis familiaris
ugguagacuauggaacguaggcuuugugauuuuugaccuauguaacaugguccacuaac

SEQ ID NO: 2969 - RNA, 57 nt, Canis familiaris
augguugaccauagaacaugcgcuagcucuaugucguauguaauaugguccacgucu

SEQ ID NO: 2970 - RNA, 75 nt, Canis familiaris
uacuuaaagcgagguugcccuuuguauauucgguuuauugacauagaauauacaagggcaagcucucugugagua

SEQ ID NO: 2971 - RNA, 57 nt, Canis familiaris
aaguuguucgugguggauucgcuuuacuuaugacgaaucauucacggacaacacuuu

SEQ ID NO: 2972 - RNA, 62 nt, Canis familiaris
agaucagaaggugauuguggcuuuggguggauauuaaucagccacagcacugccuggucaga

SEQ ID NO: 2973 - RNA, 63 nt, Canis familiaris
uguaaacaauuccuaggcaauguguauaauguuuguaagucauuccuagaaauuguucacaau

SEQ ID NO: 2974 - RNA, 54 nt, Canis familiaris
agguuacccgagcaacuuugcaucuggacgacgaauguugcucguugaaccccu

SEQ ID NO: 2975 - RNA, 56 nt, Canis familiaris
agguugucugugaugaguucgcuuuauuaaugccgaauauaacacagauggccugu

SEQ ID NO: 2976 - RNA, 58 nt, Canis familiaris
auaguagaccguauagcguacgcuuuaucugugacguauguaacacgguccacuaacc

SEQ ID NO: 2977 - RNA, 56 nt, Canis familiaris
cucauuaaauguuuguugaaugaaaaaaugaaucaucaacagacauuaauugggcg

SEQ ID NO: 2978 - RNA, 59 nt, Canis familiaris
ugaggggcagagagcgagacuuuucuauuuuccaaaagcucggucugaggccccucagu

SEQ ID NO: 2979 - RNA, 57 nt, Canis familiaris
agcagcaauucauguuuugaagugcuuuaaaugguucaaaacgugaggcgcugcuau

SEQ ID NO: 2980 - RNA, 63 nt, Canis familiaris
aaugacacgaucacucccguugagugggcacccaagaagccaucgggaaugucguguccgccc

SEQ ID NO: 2981 - RNA, 85 nt, Canis familiaris
agccugcugaugggcgucuuaccagacacgguuagaucuggguucuggugucuaauacugucugguaaugccguucauccauggc

SEQ ID NO: 2982 - RNA, 87 nt, Canis familiaris
ugacuccuccaggucuuggaguaggucauuggguggauccuuaauuucccuaugugggccacuggauggcuccuccaugucuuggcg

SEQ ID NO: 2983 - RNA, 74 nt, Canis familiaris
uacggugagccugucauuauucagagaggcuagauccucuguguugagaaggaucaugaugggcuccucggugu

SEQ ID NO: 2984 - RNA, 110 nt, Canis familiaris
gcagggagguugaacauccugcauagugcugccaggaaaucccuauuuuauacuaagggggcuggcugguugcauauguaggaugucccaucuccccgcccacuucaucg

SEQ ID NO: 2985 - RNA, 91 nt, Canis familiaris
ccgugugugauggguuggcaguguauuguuagcugguugaauauaugaauggcaucagcuaacaugcaacugcuaucuuauugcauauaca

SEQ ID NO: 2986 - RNA, 91 nt, Canis familiaris
gaaagaugcugaacuguuuuugcgauguguuccuaauaugcaguaugaacauauugggagcauuuugcaugcaugguuuuguaucaauaua

SEQ ID NO: 2987 - RNA, 58 nt, Canis familiaris
uuuugcaauauguuccugaauauguaauauaaguguauugggaacauuuugcauccau

SEQ ID NO: 2988 - RNA, 69 nt, Canis familiaris
uuggggauggcgaggaaaccguuaccauuacugaguuuaguaaugguaaugguucucuugcuguaccca

SEQ ID NO: 2989 - RNA, 85 nt, Canis familiaris
gcuaagcacuuacaacuguuugcagaggaaacugagacuuuguaacuacaucucagucucaucugcaaagaaguaagugcuuugc

SEQ ID NO: 2990 - RNA, 70 nt, Canis familiaris
agaacccuaucgauauugucucugcuguguaaauagcucugaguagugcaauauugcuuauaggguuuug

SEQ ID NO: 2991 - RNA, 58 nt, Canis familiaris
uaugugccuuuggacuacaucguggaagccagcaccaugcaguccaugggcauauaca

SEQ ID NO: 2992 - RNA, 69 nt, Canis familiaris
gaggacgggaggaaaggaggacgugguuucaugcagguccucacuccuccccucccgucuuccucuucc

SEQ ID NO: 2993 - RNA, 59 nt, Canis familiaris
agaggcuggccgugaugaauucgauucaucaaagcgagucauacacggcucuccucucu

SEQ ID NO: 2994 - RNA, 80 nt, Canis familiaris
gguacuugaagagugguuaucccugcuguguucgcuguauuuaugacgaaucauacagggacauccaguuuuucaguauc

SEQ ID NO: 2995 - RNA, 58 nt, Canis familiaris
gugguuaucccuguccuguucguuuuacucaugucgaaucguacagggucauccacuu

SEQ ID NO: 2996 - RNA, 83 nt, Canis familiaris
gagaaucaucucucccagauaauggcacucucaaacaaguuuucaaguuguuugaaaggcuauuucuuggucagaagacucuc

SEQ ID NO: 2997 - RNA, 84 nt, Canis familiaris
guggcagcuugguggccguauguguggcgccauuuacuugaaccuuuaggagugacaucacauauacggcggcuaaacugcuac

SEQ ID NO: 2998 - RNA, 81 nt, Canis familiaris
aaaguucauuguucgacaccauggaucuccaggugggucacguuuagagauacaccaaccuggaggacuccaugcuguuga

SEQ ID NO: 2999 - RNA, 54 nt, Canis familiaris
guggggaacccuuccaugaggaguagaacacuccuuaugcaagauucccuucua

SEQ ID NO: 3000 - RNA, 61 nt, Canis familiaris
uguacaugguaggcuuucauucauucguuugcacauucggugaaggucuacugugugccag

SEQ ID NO: 3001 - RNA, 81 nt, Canis familiaris; identical to SEQ ID NO: 309

SEQ ID NO: 3002 - RNA, 58 nt, Canis familiaris
gaaguugcccguguuauuuucgcuugauacgugccgaaacaaacauggugcacuucuu

SEQ ID NO: 3003 - RNA, 98 nt, Canis familiaris
agucagguacuugaauggagguuguccaugguguguucauuuuauuuaugaugaguauuacauggccaaucuccuuucaguacuaaauucuucuuggg

SEQ ID NO: 3004 - RNA, 67 nt, Canis familiaris
cagcagcacacugugguuuguacgguacuguggccacguccagaccacacugugguguuagggugag

SEQ ID NO: 3005 - RNA, 59 nt, Canis familiaris
uuaagacuugcagugauguuuaacuccucuccacgugaacaucacagcaagucugugcu

SEQ ID NO: 3006 - RNA, 59 nt, Canis familiaris
aauccuugcuaccugggugagagugcuuucugaaugcaaugcaccugggcaaggauucu

SEQ ID NO: 3007 - RNA, 59 nt, Canis familiaris
aauccuugcuaucugggugcuagugcugucucaaugcaaugcaccugggcaaggauuca

SEQ ID NO: 3008 - RNA, 63 nt, Canis familiaris
uagcagcgggaacaguacugcagugggcaaucgguguucuggaguauuguuucugcugcccgg

SEQ ID NO: 3009 - RNA, 83 nt, Canis familiaris
gcugcuguugggagacccuggucugcacucuaucuguaugcuuacugaagggagcgcagggcaggguuucccauacagagggc

SEQ ID NO: 3010 - RNA, 76 nt, Canis familiaris
cagugggggagccaggaaguauugauguuucugccaguuuagcgucaacacuugcugguuuccucucuggagcauc

SEQ ID NO: 3011 - RNA, 77 nt, Canis familiaris
guacccuacuccagagaguggcaaucauuuguaauuauaugugauugacaccucugugaguggaguaaugcaugaca

SEQ ID NO: 3012 - RNA, 59 nt, Canis familiaris
caugccuugaguguaggaccguugguaucuuaauuacccucccacacccaaggcuugca

SEQ ID NO: 3013 - RNA, 76 nt, Canis familiaris
uacuugaggagaaauuauccuugguguguucgcuguguuugugaggaaucauacaaggacaauuucuuuuugagua

SEQ ID NO: 3014 - RNA, 59 nt, Canis familiaris
ucggggaucaucaugucacgagauaccacugugcacuugugacagauugauaacugaaa

SEQ ID NO: 3015 - RNA, 58 nt, Canis familiaris
gaaguugcccguguuuuuuucgcuuuauuugugacgaaacauucgcggugcacuucuu

SEQ ID NO: 3016 - RNA, 89 nt, Canis familiaris
auuuucaucaccuagggaucuuguuaaaaggcagauucugauuuagggaccaagauucugcauuuuuagcaaguucccaagugaugcua

SEQ ID NO: 3017 - RNA, 106 nt, Canis familiaris
cccagccuggcacauuaguaggccucaguaaauguuuauuggaugaauaaaugaaugacucaucaacaaacauuuaucgugugccugcuaaggugaucuccacagg

SEQ ID NO: 3018 - RNA, 94 nt, Canis familiaris
ggggacugccaggugacccuggaaauccagaguggguaaggccugucugauugugucuaggcgacccacucuugguuuccaugguugcccugga

SEQ ID NO: 3019 - RNA, 90 nt, Canis familiaris
gugcucuccuggcccaugaaaucaagugugggugagaccuggugcacagcgggaaggcgacccauacuugguuucagaggcugcgagaau

SEQ ID NO: 3020 - RNA, 86 nt, Canis familiaris
auacacuauauuauguauaaauguauacacacuuccuauauauauccauauauauauaguguauauauuauacauguauaggugug

SEQ ID NO: 3021 - RNA, 58 nt, Canis familiaris
ugagugugugugugugagugugugucgcuccggguccacgcucaugcacacacccaca

SEQ ID NO: 3022 - RNA, 69 nt, Canis familiaris
ccaaguagcuucuugugcucuagauugguguuuuucauaguguggagucaagaaguugcuuuagggauc

SEQ ID NO: 3023 - RNA, 81 nt, Canis familiaris
acucuuugguuacaguuguucaaccaguuacuaaucuagcuaauuguaaccaguugaacaacugaacccaaagggugcaaa

SEQ ID NO: 3024 - RNA, 72 nt, Canis familiaris
ggcucugagaaccaugucugaucagagcuggguacugccuguucagaacagacaccggucucuaagacgcag

SEQ ID NO: 3025 - RNA, 61 nt, Canis familiaris
gagcuuauucauaaaaguacaguaugauccaguaaaccuguaauuuuauguauaagcuagu

SEQ ID NO: 3026 - RNA, 95 nt, Canis familiaris
ugauauuaugccaugacauugugucaauaugcgaugaugugugugauggcacagcgucaucacguggugacgcaacaucaugacguaagacauca

SEQ ID NO: 3027 - RNA, 95 nt, Canis familiaris
aaagaccugcuguccacaguguguuugauaagcugacaugggacagggauucuuuucacuguugugucaguuuaucaaacccauaccuggaugac

SEQ ID NO: 3028 - RNA, 85 nt, Canis familiaris
ucgggaggggcgggagggggguccccggagcucggucucgagggugcuuauuguucgguccgagcccgggucucccucucccccc

SEQ ID NO: 3029 - RNA, 95 nt, Canis familiaris; identical to SEQ ID NO: 541

SEQ ID NO: 3030 - RNA, 68 nt, Canis familiaris
ccgaccuggcccagaccucagccccauagcugaugggcugagucaggggccaaggcuccccucgucca

SEQ ID NO: 3031 - RNA, 97 nt, Canis familiaris
cgccuccggccgcagugccugacgggagcagagcggcgaacgagggcgucggccauuuugugucuguuuccugugggacgcggucguggccguuggc

SEQ ID NO: 3032 - RNA, 63 nt, Canis familiaris
acaacccuaggagagggugccauucacauagacuauaauugaauggcgccacuaggguugugc

SEQ ID NO: 3033 - RNA, 91 nt, Canis familiaris
ucauuccuucaguguugaaacaaucucuauugaaccaggcuccaaaccaaguucacuggaguuuguuucaauauugcaagaaugauaagau

SEQ ID NO: 3034 - RNA, 59 nt, Canis familiaris
uacccauugcauaucggaguugugaauucucaaagcaccuccugugugcauggauuaca

SEQ ID NO: 3035 - RNA, 61 nt, Canis familiaris
ugggcuaggaaaaaugauuggauaaaaaauauuauucuauucauuuaucucccagccuaca

SEQ ID NO: 3036 - RNA, 68 nt, Canis familiaris
ucccgcggccucagccuccacccggggcucuguccggaccaggaggcuaaggccccucacggcggcug

SEQ ID NO: 3037 - RNA, 74 nt, Canis familiaris
caggaagaggaggaagcccuggaggggcuggaggugauggauguuuuccuccgguucucagggcuccaccucuu

SEQ ID NO: 3038 - RNA, 57 nt, Canis familiaris
cucuucaaucucaggacucgcagaauuaauggaaugccguccuaagguuggugaguu

SEQ ID NO: 3039 - RNA, 69 nt, Canis familiaris
aaggagcuuacaaucuagcugggggugaacggcuugcacaugaacgcaacuagacugugagcuucuaga

SEQ ID NO: 3040 - RNA, 72 nt, Canis familiaris
gcggcggcggcgggcaagauggcggcgggcccgggccccgccccuuccgccccgccgggcgccgcacgaggc

SEQ ID NO: 3041 - RNA, 81 nt, Canis familiaris
cuggguacaugagaugguugaccagagagcacacgcuuuauuugugccguuugugaccugguccacuaacccucaguaucu

SEQ ID NO: 3042 - RNA, 96 nt, Canis familiaris
ggauuauaauaaauuaaaugccuaaacuggcagagugcaaacaauuuugccucagaucuaaauguuugcacuggcuguuuaaacauuuaauuuguu

SEQ ID NO: 3043 - RNA, 70 nt, Canis familiaris
uggcaagaggaggagcagcagggugaaacugacacaguucuggugaguuucacuuugcugcuccuccuga

SEQ ID NO: 3044 - RNA, 96 nt, Canis familiaris
aaucuaggaggcaggugcucacuuguccuccuccgugcuuggaaaauacagggaggaggccauaguggcaacugucaccaugauugauuucguugg

SEQ ID NO: 3045 - RNA, 90 nt, Canis familiaris
uucuauuauuuguacucaguaacaaagauucauccuuguguccgucaagcaacaaggagaaucuuugucacuuaguguaauuaauagcug

SEQ ID NO: 3046 - RNA, 73 nt, Canis familiaris
uuguuagaagguuauguguuagcucaaggcuucauuauuuccugccugaccuauugaaguagccuucuaacgg

SEQ ID NO: 3047 - RNA, 78 nt, Canis familiaris; identical to SEQ ID NO: 604

SEQ ID NO: 3048 - RNA, 74 nt, Canis familiaris
gugguacuauaccucaguuuuaucagguguucuuuaaaaucaccuggaaauacugagguuguguuucacugaac

SEQ ID NO: 3049 - RNA, 81 nt, Canis familiaris; identical to SEQ ID NO: 606

SEQ ID NO: 3050 - RNA, 74 nt, Canis familiaris
ccgcgcucucuccauuacacuacccugccucuucuccaugagaggcagcgggguguaguggauagagcacgggu

SEQ ID NO: 3051 - RNA, 119 nt, Canis familiaris
agccugcgccgaagccggggccugagcccaggccgcgcaggccgagaacucgucgagcugcgugugcggccggugcucagccugccgggucccggccccgcgcucccgcgcgcuuugga

SEQ ID NO: 3052 - RNA, 58 nt, Canis familiaris
cuuggcaccuaguaagcacucaguaaauacuuguugagugccugcuaugugccaggca

SEQ ID NO: 3053 - RNA, 58 nt, Canis familiaris
ccaccuccccugcaaacguccagugaugcagagguaauggacguuggcucugguggug

SEQ ID NO: 3054 - RNA, 60 nt, Canis familiaris
cgaccggaccucgaccggcucgucuauguugccaaucgacucggcguggcgucggucgug

SEQ ID NO: 3055 - RNA, 61 nt, Canis familiaris
ugcacccugagagcuggagcaggucucuuacgggaaccaucuucaacucuguggaugcagg

SEQ ID NO: 3056 - RNA, 57 nt, Canis familiaris
uaggccaugguagauagagauggaguaaccauuucaucucaucugcacugcccagac

SEQ ID NO: 3057 - RNA, 59 nt, Canis familiaris
augugauggcucuucugagaaguacuucgauggcuccucucagagggacugcgacaucu

SEQ ID NO: 3058 - RNA, 59 nt, Canis familiaris; identical to SEQ ID NO: 3057

SEQ ID NO: 3059 - RNA, 59 nt, Canis familiaris; identical to SEQ ID NO: 3057

SEQ ID NO: 3060 - RNA, 59 nt, Canis familiaris; identical to SEQ ID NO: 3057

SEQ ID NO: 3061 - RNA, 58 nt, Canis familiaris
ccaccagcuggcguucccuggcgugggaacgagaggcaggggcugcuggcuggaggga

SEQ ID NO: 3062 - RNA, 73 nt, Canis familiaris
aaggaaaagguagauagaacaggucuuguuagcaaaauaaauucaagaccuacuuaaucuaccaacagcaauu

SEQ ID NO: 3063 - RNA, 57 nt, Canis familiaris
uuagggcgcgucacgugacgggcucgucgcuccgccgucacgugacgggccucggcg

SEQ ID NO: 3064 - RNA, 60 nt, Canis familiaris
agaggaaagcuggacggcaagccugaagggaagaagguggcuccguccucuuuccaagcc

SEQ ID NO: 3065 - RNA, 60 nt, Canis familiaris
uggcucugcgaggucagcucaaggugggucuggauauugagcaggccugucagggcguug

SEQ ID NO: 3066 - RNA, 60 nt, Canis familiaris
acuggaggucucugucuggcuuaggacagcuggcuaagucugaucguuccccuccauaca

SEQ ID NO: 3067 - RNA, 60 nt, Canis familiaris
aggacuacggacgggcugagcuuucaggcuccccacagcucugcccgacucugguucgca

SEQ ID NO: 3068 - RNA, 72 nt, Equus caballus; identical to SEQ ID NO: 2

SEQ ID NO: 3069 - RNA, 74 nt, Equus caballus
gggugagguaguagguuguauaguuuggggcucugcccugcuaugggguaacuauacaaucuacugucuuuccu

SEQ ID NO: 3070 - RNA, 71 nt, Equus caballus
gguugagguaguagguuguaugguuuagaguuacacccugggaguuaacuguacaaccuucuagcuuuccu

SEQ ID NO: 3071 - RNA, 87 nt, Equus caballus
ccuaggaagagguaguagguugcauaguuuuagggcagggauuuugcccacaaggagauaacuauacgaccugcugccuuucuuagg

SEQ ID NO: 3072 - RNA, 79 nt, Equus caballus
cccgggcugagguaggagguuguauaguugaggaggacacccacggagaucacuauacggccuccuagcuuuccccagg

SEQ ID NO: 3073 - RNA, 87 nt, Equus caballus
ucggagugagguaguagauuguauaguugugggguagugauuuuacccuguucaggagauaacuauacaaucuauugccuucccuga

SEQ ID NO: 3074 - RNA, 88 nt, Equus caballus
ccaggcugagguaguaguuuguacaguuugagggucuaugauaccacccgguacaggagauaacuguacaggccacugccuugccagg

SEQ ID NO: 3075 - RNA, 78 nt, Equus caballus
uacucagaguacauacuucuuuauguacccauaugaacauacaaugcuauggaauguaaagaaguauguauuuuuggu

SEQ ID NO: 3076 - RNA, 76 nt, Equus caballus
gcuugggaaacauacuucuuuauaugcccauauggaccugcuaagcuauggaauguaaagaaguauguauuucagg

SEQ ID NO: 3077 - RNA, 60 nt, Equus caballus
uggaagacuagugauuuuguuguugucuugcugcgcccaacaacaagucccagucugccg

SEQ ID NO: 3078 - RNA, 84 nt, Equus caballus
ggucuagugcuguguggaagacuagugauuuuguuguuuugacguacuaugacaacaaaucacggcuuccucacagcguaggcu

SEQ ID NO: 3079 - RNA, 88 nt, Equus caballus
uggucuaguucuguguggaagacuagugauuuuguuguuuguagauaacuaaaucgacaacaaaucacagucugccauauggcacagg

SEQ ID NO: 3080 - RNA, 79 nt, Equus caballus
uugguuguuaucuuugguuaucuagcuguaugagugguguggagucuucauaaagcuagauaaccgaaaguaaaaauaa

SEQ ID NO: 3081 - RNA, 78 nt, Equus caballus
gaguuguuaucuuugguuaucuagcuguaugaguguauuggucuucauaaagcuagauaaccgaaaguaaaaacuccu

SEQ ID NO: 3082 - RNA, 110 nt, Equus caballus
aagaugucugucuucuguauauacccuguagauccgaauuuguguaaggaauuuuguggucacaaauucguaucuaggggaauauguaguugacauaaacacuccgcuca

SEQ ID NO: 3083 - RNA, 68 nt, Equus caballus
uauauacccuguagaaccgaauuugugugguauccacauagucacagauucgauucuaggggaauaua

SEQ ID NO: 3084 - RNA, 57 nt, Equus caballus
uagcagcacauaaugguuuguggauuuugaaaaggugcaggccauauugugcugccu

SEQ ID NO: 3085 - RNA, 64 nt, Equus caballus
cuguagcagcacaucaugguuuacauacuacagucaagaugcgaaucauuauuugcugcucuag

SEQ ID NO: 3086 - RNA, 81 nt, Equus caballus
guuccgcucuagcagcacguaaauauuggcguagugaaauaaauauuaaacaccaauauuauugugcugcuuuagcguggc

SEQ ID NO: 3087 - RNA, 63 nt, Equus caballus
uagcagcacguaaauauuggcguuaagauucuaaaauuaucuccaguauuaacugugcugcug

SEQ ID NO: 3088 - RNA, 59 nt, Equus caballus
caaagugcuuacagugcagguagugauauaugugcaucuacugcagugaaggcacuugu

SEQ ID NO: 3089 - RNA, 61 nt, Equus caballus
uaaggugcaucuagugcagauagugaaguagauuagcaucuacugcccuaagugcuccuuc

SEQ ID NO: 3090 - RNA, 59 nt, Equus caballus
uaaggugcaucuagugcaguuagugaagcagcuuagaaucuacugcccuaaaugccccu

SEQ ID NO: 3091 - RNA, 82 nt, Equus caballus
gcagucuucuguuaguuuugcauaguugcacuacaagaagaauguaguugugcaaaucuaugcaaaacugaugguggccugc

SEQ ID NO: 3092 - RNA, 64 nt, Equus caballus
guuaguuuugcagguuugcauccagcugugugauguucugcugugcaaauccaugcaaaacuga

SEQ ID NO: 3093 - RNA, 96 nt, Equus caballus
acacugcuacuuacgauuaguuuugcagguuugcauuucagcguauauauguauauauggcugugcaaauccaugcaaaacugauugugauaaugu

SEQ ID NO: 3094 - RNA, 71 nt, Equus caballus; identical to SEQ ID NO: 128

SEQ ID NO: 3095 - RNA, 69 nt, Equus caballus
aguaccaaagugcucauagugcagguaguuuuggcauuacucuacuguagugugggcacuuccaguacu

SEQ ID NO: 3096 - RNA, 72 nt, Equus caballus
ugucggguagcuuaucagacugauguugacuguugaaucucauggcaacagcagucgaugggcugucugaca

SEQ ID NO: 3097 - RNA, 85 nt, Equus caballus; identical to SEQ ID NO: 144

SEQ ID NO: 3098 - RNA, 73 nt, Equus caballus
ggccggcugggguuccuggggaugggauuugcugcuugucacaaaucacauugccagggauuuccaaccgacc

SEQ ID NO: 3099 - RNA, 74 nt, Equus caballus
ggcugcuuggguuccuggcaugcugauuugugacuuaagauuaaaaucacauugccagggauuaccacgcaacc

SEQ ID NO: 3100 - RNA, 68 nt, Equus caballus
cucccgugccuacugagcugaaacacaguugguuugugcagacuggcucaguucagcaggaacaggag

SEQ ID NO: 3101 - RNA, 68 nt, Equus caballus; identical to SEQ ID NO: 152

SEQ ID NO: 3102 - RNA, 84 nt, Equus caballus; identical to SEQ ID NO: 154

SEQ ID NO: 3103 - RNA, 84 nt, Equus caballus; identical to SEQ ID NO: 156

SEQ ID NO: 3104 - RNA, 77 nt, Equus caballus
guggccucguucaaguaauccaggauaggcugugcaggucccaaugggccuauucuugguuacuugcacgcggacgc

SEQ ID NO: 3105 - RNA, 77 nt, Equus caballus
cuggggagcagggcuuagcugcuugugagcaggguccacaccgagucauguucacaguggcuaaguuccgccccccg

SEQ ID NO: 3106 - RNA, 73 nt, Equus caballus
aggugcagagcuuagcugauuggugaacagugacugguuuccgcuuuguucacaguggcuaaguucugcaccu

SEQ ID NO: 3107 - RNA, 86 nt, Equus caballus
gguccuugcccucaaggagcucacagucuauugaguugccuuucugacuuucccacuagauugugagcuccuggagggcaggcacu

SEQ ID NO: 3108 - RNA, 65 nt, Equus caballus
gaugacugauuucuuuugguguucagagucaauauaauuuucuagcaccaucugaaaucgguuau

SEQ ID NO: 3109 - RNA, 81 nt, Equus caballus; identical to SEQ ID NO: 166

SEQ ID NO: 3110 - RNA, 81 nt, Equus caballus; identical to SEQ ID NO: 167

SEQ ID NO: 3111 - RNA, 88 nt, Equus caballus; identical to SEQ ID NO: 168

SEQ ID NO: 3112 - RNA, 88 nt, Equus caballus
aucucuuacacaggcugaccgauuucuccugguguucagagucuguuuuugucuagcaccauuugaaaucgguuaugacguaggggga

SEQ ID NO: 3113 - RNA, 58 nt, Equus caballus
uguaaacauccuacacucagcuguacuacauggauuggcugggagguggauguuuacu

SEQ ID NO: 3114 - RNA, 89 nt, Equus caballus; identical to SEQ ID NO: 180

SEQ ID NO: 3115 - RNA, 60 nt, Equus caballus
uguaaacauccuacacucucagcuguggaaagugagaaagcugggagaaggcuguuuacu

SEQ ID NO: 3116 - RNA, 71 nt, Equus caballus
ugugguuguaaacauccccgacuggaagcugugagacauggcuaagcuuucagucagauguuugcugcgac

SEQ ID NO: 3117 - RNA, 92 nt, Equus caballus; identical to SEQ ID NO: 183

SEQ ID NO: 3118 - RNA, 67 nt, Equus caballus
ggagaggaggcaagaugcuggcauagcuguugaacugagaaccugcuaugccaacauauugccaucu

SEQ ID NO: 3119 - RNA, 70 nt, Equus caballus
ggagauauugcacauuacuaaguugcacguugucacggccucagugcaauuuagugugugugauauuuuc

SEQ ID NO: 3120 - RNA, 69 nt, Equus caballus
cuguggugcauuguaguugcauugcauguucuggcgguacccaugcaauguuuccacagugcaucacag

SEQ ID NO: 3121 - RNA, 56 nt, Equus caballus
gugcauugcuguugcauugcacgugugugaggcgggugcagugccucggcagugca

SEQ ID NO: 3122 - RNA, 63 nt, Equus caballus
uggcagugucuuagcugguuguugugaguaauagugcgggaagcaaucagcaaguauacugcc

SEQ ID NO: 3123 - RNA, 84 nt, Equus caballus
gugcucgguuuguaggcaguguaauuagcugauuguacucuggagcuuacaaucacuaacuccacugccaucaaaacaaggcac

SEQ ID NO: 3124 - RNA, 77 nt, Equus caballus
agucuaguuacuaggcaguguaguuagcugauugcuaauaauaccaaucacuaaccacacggccagguaaaaagauu

SEQ ID NO: 3125 - RNA, 61 nt, Equus caballus
acagguugggaucgguugcaaugcuguguuucuguaugguauugcacuugucccggccugu

SEQ ID NO: 3126 - RNA, 75 nt, Equus caballus
ucauccguggguggggauuuguugcauuacuuguguuauauauaaaguauugcacuugucccggccuguggaaga

SEQ ID NO: 3127 - RNA, 75 nt, Equus caballus
gggcgggagggacgggacgcggugcaguguuguucuuucccccgccaauauugcacucgucccggccuccggccc

SEQ ID NO: 3128 - RNA, 59 nt, Equus caballus
caaagugcuguucgugcagguagugugauuaccugaccuacugcugagcuagcacuucc

SEQ ID NO: 3129 - RNA, 81 nt, Equus caballus
aacacagugggcgcucaauaaauguuuguugaauugagaugcguuaaauucaacgggucuuuauugagcaaccacucugug

SEQ ID NO: 3130 - RNA, 78 nt, Equus caballus; identical to SEQ ID NO: 288

SEQ ID NO: 3131 - RNA, 119 nt, Equus caballus
aggauucugcucaugccagggugagguaguaaguuguauuguugugggguagggauuuuaggccccaauuagaagauaacuauacaacuuacuacuuucccugguguguggcauauuca

SEQ ID NO: 3132 - RNA, 81 nt, Equus caballus
cccauuggcauaaacccguagauccgaucuuguggugaaguggaccucacaagcucgcuucuaugggucugugucagugug

SEQ ID NO: 3133 - RNA, 70 nt, Equus caballus; identical to SEQ ID NO: 291

SEQ ID NO: 3134 - RNA, 55 nt, Equus caballus
aacccguagauccgaacuuguggugauaguccacacaagcuugugucuauaggua

SEQ ID NO: 3135 - RNA, 59 nt, Equus caballus
cucaguuaucacagugcugaugcugucaguucuaaagguacaguacugugauaacugaa

SEQ ID NO: 3136 - RNA, 72 nt, Equus caballus
ccuuuuucgguuaucaugguaccgaugcuguauaucugaaagguacaguacugugauaacugaagaauggug

SEQ ID NO: 3137 - RNA, 78 nt, Equus caballus
ucgugcuuucagcuucuuuacagugcugccuuguagcauucaggucaagcagcauuguacagggcuaugaaagaacca

SEQ ID NO: 3138 - RNA, 81 nt, Equus caballus
ugugcaucguagucaaaugcucagacuccugugguggccguucaugcaccacggauguuugagcaugugcuauggugucua

SEQ ID NO: 3139 - RNA, 81 nt, Equus caballus
ccuuggccaugucaaagugcuuacagugcagguagcuuucugagaucuacugcaaugcaagcacuucuuacauuaccaugg

SEQ ID NO: 3140 - RNA, 59 nt, Equus caballus
uaaagugcugacagugcagauagugguccucuccaugcuaccgcacuguggguacuugc

SEQ ID NO: 3141 - RNA, 72 nt, Equus caballus
cucacugcccucggcuucuuuacagugcugccuuguugcggauggaucaagcagcauuguacagggcuauga

SEQ ID NO: 3142 - RNA, 81 nt, Equus caballus; identical to SEQ ID NO: 23

SEQ ID NO: 3143 - RNA, 66 nt, Equus caballus
agcuguggagugugacaaugguguuuguguccaaacuaucaaacgccauuaucacacuaaauagcu

SEQ ID NO: 3144 - RNA, 68 nt, Equus caballus
cucuccguguucacagcggaccuugauuuaaauguccauacaauuaaggcacgcggugaaugccaaga

SEQ ID NO: 3145 - RNA, 56 nt, Equus caballus
guguucacagcggaccuugauuuaaugucauacaauuaaggcacgcggugaaugcc

SEQ ID NO: 3146 - RNA, 68 nt, Equus caballus
cugggucccugagacccuuuaaccugugaggacauccagggucacaggugagguucuugggagccugg

SEQ ID NO: 3147 - RNA, 88 nt, Equus caballus
ugcgcuccucucaaucccugagacccuaacuugugauguuuaccguuuaaauccacggguuaggcucuugggagcugcgagucgugcc

SEQ ID NO: 3148 - RNA, 70 nt, Equus caballus
ccuagucccugagacccuaacuugugagguauuuugguaacaucacaagucaggcucuugggaccuaggc

SEQ ID NO: 3149 - RNA, 73 nt, Equus caballus
cgacgggacauuauuacuuuugguacgcgcugugacacuucaaacucguaccgugaguaauaaugcgccgucg

SEQ ID NO: 3150 - RNA, 70 nt, Equus caballus
ccagccugcugaagcucagagggcucugauucagaaagaucaucggauccgucugagcuuggcuggucgg

SEQ ID NO: 3151 - RNA, 84 nt, Equus caballus
ugugcagugggaaggggggccgaugcacuguacgagagugaguagcaggucucacagugaaccggucucuuucccuacuguguc

SEQ ID NO: 3152 - RNA, 70 nt, Equus caballus
guuggauucggggccguagcacugucugagagguuuacauuucucacagugaaccggucucuuuuucagc

SEQ ID NO: 3153 - RNA, 73 nt, Equus caballus
uggaucuuuuugcggucugggcuugcuguuccucucaacaguagucaggaagcccuuaccccaaaaaguaucu

SEQ ID NO: 3154 - RNA, 74 nt, Equus caballus
gcgaaucuuuuugcggucugggcuugcuguacauaacucaauagccggaagcccuuaccccaaaaagcauucgc

SEQ ID NO: 3155 - RNA, 64 nt, Equus caballus
gagcucuuuucacauugugcuacugucugcaccuaccacuagcagugcaauguuaaaagggcau

SEQ ID NO: 3156 - RNA, 81 nt, Equus caballus
ggccugccugacacucuuucccuguugcacuacugugggcugcuggaagcagugcaaugaugaaagggcaucggucaggcc

SEQ ID NO: 3157 - RNA, 66 nt, Equus caballus
ggacaaccguggcuuucgauuguuacugugggaaccggagguaacagucuacagccauggucgccc

SEQ ID NO: 3158 - RNA, 68 nt, Equus caballus
gcuagagcugguaaaauggaaccaaaucgccucuucaauggauuugguccccuucaaccagcuguagc

SEQ ID NO: 3159 - RNA, 68 nt, Equus caballus
gcuaaagcugguaaaauggaaccaaaucaacuguucaauggauuugguccccuucaaccagcuguagc

SEQ ID NO: 3160 - RNA, 61 nt, Equus caballus
uggcuggucaaacggaaccaaguccgucuuccugagagguuugguccccuucaaccagcua

SEQ ID NO: 3161 - RNA, 71 nt, Equus caballus
agggugugugacugguugaccagaggggcaagcacucuguucacccugugggccaccuagucaccaacccu

SEQ ID NO: 3162 - RNA, 60 nt, Equus caballus
cuauggcuuuuuauuccuaugugauucuacugcucacucauauagggauuggagccgugg

SEQ ID NO: 3163 - RNA, 100 nt, Equus caballus; identical to SEQ ID NO: 49

SEQ ID NO: 3164 - RNA, 89 nt, Equus caballus
gcucugcuguggccuauggcuuuucauuccuaugugauugcuguucuaaacucauguagggcuaaaagccaugggcuacagugaggggc

SEQ ID NO: 3165 - RNA, 62 nt, Equus caballus
gaggacuccauuuguuuugaugauggauucuuacgcuccaucaucgucucaaaugagucuuc

SEQ ID NO: 3166 - RNA, 73 nt, Equus caballus
cuucggugacggguauucuuggguggauaauacggauuacguuguuauugcuuaagaauacgcguagucgagg

SEQ ID NO: 3167 - RNA, 84 nt, Equus caballus
cguugcugcagcugguguugugaaucaggccgacgagcagugcauccucuuacccggcuauuucacgacaccaggguugcauca

SEQ ID NO: 3168 - RNA, 59 nt, Equus caballus
agcugguguugugaaucaggccguugccaaucagagaacggcuacuucacaacaccagg

SEQ ID NO: 3169 - RNA, 63 nt, Equus caballus
uacucuacagugcacgugucuccaguguggcuccgaggcuggagacgcggcccuguuggagua

SEQ ID NO: 3170 - RNA, 61 nt, Equus caballus
ccagugguuuuacccuaugguagguuacgucaugcuguucuaccacaggguagaaccacgg

SEQ ID NO: 3171 - RNA, 72 nt, Equus caballus
ggguccaucuuccaguacaguguuggauggucuaauugugaagcuccuaacacugucugguaaagauggccc

SEQ ID NO: 3172 - RNA, 64 nt, Equus caballus
acccauaaaguagaaagcacuacuaacagcacuggaggguguaguguuuccuacuuuauggaug

SEQ ID NO: 3173 - RNA, 64 nt, Equus caballus
gcccgaggugcagugcugcaucucuggucaguugggagucugagaugaagcacuguagcucagg

SEQ ID NO: 3174 - RNA, 66 nt, Equus caballus
ggcugggauaucaucauauacuguaaguuugcgaugagacacuacaguauagaugauguacuaguc

SEQ ID NO: 3175 - RNA, 70 nt, Equus caballus
cucacgguccaguuuucccaggaaucccuuagaugcuaagauggggauuccuggaaauacuguucuugag

SEQ ID NO: 3176 - RNA, 65 nt, Equus caballus
agcuuugagaacugaauuccauggguugugucagcgucagaccugugaaguucaguucuucagcu

SEQ ID NO: 3177 - RNA, 74 nt, Equus caballus
ccuggcucugagaacugaauuccauaggcugugagcuccagcaaaugcccuagggacucaguucuggugcccgg

SEQ ID NO: 3178 - RNA, 80 nt, Equus caballus
uaggaauguuaaggagaccauucugcacaaacuggaguauggauaucagugugccgaaaugcuucugcuacauuuuuagg

SEQ ID NO: 3179 - RNA, 68 nt, Equus caballus
gaggcaaaguucugagacacuccgacucugaauaugauagaagucagugcacuacagaacuuugucuc

SEQ ID NO: 3180 - RNA, 83 nt, Equus caballus
agcauuugaggugaaguucuguuauacacucaggcuguggcucucugaaagucagugcaucacagaacuuugucucgaaagcu

SEQ ID NO: 3181 - RNA, 89 nt, Equus caballus
gccggcgcccaggcucuggcuccgugucuucacucccguguguguccgaggagggagggagggacgggggcugugcuggggcugccgga

SEQ ID NO: 3182 - RNA, 65 nt, Equus caballus
cccugucucccaacccuuguaccagugcugugccucggucccugguacaggcauggggggcaggg

SEQ ID NO: 3183 - RNA, 69 nt, Equus caballus
ccugcccucgaggagcucacagucuaguaugucucauccccuacuagacugaagcuccuugaggacagg

SEQ ID NO: 3184 - RNA, 67 nt, Equus caballus
gugucauuuuugugauguugcagcuaguaauaugagcccaguugcauagucacaaaagugaucauug

SEQ ID NO: 3185 - RNA, 69 nt, Equus caballus
ccagugucauuuuugugaucugcagcuaguauucucgcuccaguugcauagucacaaaagugaucauug

SEQ ID NO: 3186 - RNA, 64 nt, Equus caballus
agauagguuauccguguugccuucgcuuuaucugugacgaaucauacacgguucaccuauuuuu

SEQ ID NO: 3187 - RNA, 65 nt, Equus caballus
cuguuaaugcuaaucgugauagggguuuuuaccucggacugacuccuacauguuagcauuaacag

SEQ ID NO: 3188 - RNA, 110 nt, Equus caballus
aagggcugccaggacccagccuucagaggacuccaaggaacauucaacgcugucggugaguuugggauuugaaaaaaccaccgaccguugacuguaccuugggguccuua

SEQ ID NO: 3189 - RNA, 110 nt, Equus caballus
ugagucugaggguugcuucagugaacauucaacgcugucggugaguuuggaauuaaaaucaaaaccaucgaccguugauugugcccuguggcuagccauccucuccucca

SEQ ID NO: 3190 - RNA, 89 nt, Equus caballus; identical to SEQ ID NO: 85

SEQ ID NO: 3191 - RNA, 75 nt, Equus caballus
accauuuuuggcaaugguagaacucacacuggugagguaaugggauccggugguucuagacuugccaacuauggu

SEQ ID NO: 3192 - RNA, 69 nt, Equus caballus
cuguguauggcacugguagaauucacugugaacagucucggucagugaauuaccgaagggccauaaaca

SEQ ID NO: 3193 - RNA, 70 nt, Equus caballus
acaucuccuuaucacuuuuccagccagcuuugugacucuaaguguuggacggagaacugauaaggguagg

SEQ ID NO: 3194 - RNA, 71 nt, Equus caballus
acuuuccaaagaauucuccuuuugggcuuucugauuuuauuuuaagcccaaaggugaauuuuuugggaagu

SEQ ID NO: 3195 - RNA, 61 nt, Equus caballus
ucgggcuacaacacgggacccgggcgcugcuccgaccccucgugucuuguguugcagccgg

SEQ ID NO: 3196 - RNA, 68 nt, Equus caballus
ucucacaucccuugcaugguggagggugagcuuucugaaaaccccucccacaugcaggguuugcagga

SEQ ID NO: 3197 - RNA, 67 nt, Equus caballus
cugugugauauguuugauauauuagguuguuauuuaauccaacuauauaucaaacauauuccuacag

SEQ ID NO: 3198 - RNA, 80 nt, Equus caballus
ugcuucugugugauauguuugauauuggguuguuuaauuagaaaccaacuaaaugucaaacauauucuuacagcaguggg

SEQ ID NO: 3199 - RNA, 74 nt, Equus caballus
agcgggcaacggaaucccaaaagcagcuguugucuccagagcauuccagcugcgcuuggauuucguucccugcu

SEQ ID NO: 3200 - RNA, 61 nt, Equus caballus
cugaccuaugaauugacagccagugcucuugucucccucuggcugccaauuccauagguca

SEQ ID NO: 3201 - RNA, 81 nt, Equus caballus
gggagcugagggcugggucuuugcgggcgagaugagggugucaguucaacuggccuacaaagucccagucuucggcccccg

SEQ ID NO: 3202 - RNA, 69 nt, Equus caballus
cagaaucgggguuuugagggcgagaugaguuuauguuuuauccaacuggcccacaaagucccgcuuuug

SEQ ID NO: 3203 - RNA, 85 nt, Equus caballus
gggcucccacccccuguaacagcaacuccauguggaagugcccacugguuccaguggggcugcuguuaucuggggcgggggccag

SEQ ID NO: 3204 - RNA, 85 nt, Equus caballus
auggggucaucaaguguaacagcaacuccauguggacuggguaccaauuuccaguggagaugcuguuacuuuugaugguuaccaa

SEQ ID NO: 3205 - RNA, 94 nt, Equus caballus
acacccagcuccccuggcucuagcagcacagaaauauuggcacugggaagagagucugccaauauuggcugugcugcuccaggcagggugguga

SEQ ID NO: 3206 - RNA, 70 nt, Equus caballus
gugaguuagguaguuucauguuguugggccuggauuucugaacacaacgacauuaaaccacccgacucac

SEQ ID NO: 3207 - RNA, 84 nt, Equus caballus
acuggucggugauuuagguaguuuccuguuguugggauccagcuuucucucgacagcacgacacugccuucauuacuucaguug

SEQ ID NO: 3208 - RNA, 75 nt, Equus caballus; identical to SEQ ID NO: 109

SEQ ID NO: 3209 - RNA, 79 nt, Equus caballus
gcuccgucgccccaguguucagacuaccuguucaggacaaugccguuguacaguagucugcacauugguuagacugggc

SEQ ID NO: 3210 - RNA, 69 nt, Equus caballus
gucuacccaguguuuagacuaucuguucaggacucccaaauuguacaguagucugcacauugguuaggc

SEQ ID NO: 3211 - RNA, 90 nt, Equus caballus
cugggccccugugggcaucuuaccggacagugcuggauuucucggcucgacucuaacacugucugguaacgauguucaaaggugacccac

SEQ ID NO: 3212 - RNA, 69 nt, Equus caballus
gccgucgccaucuuacugggcagcauuggaugugucuggucucuaauacugccugguaaugaugacggc

SEQ ID NO: 3213 - RNA, 64 nt, Equus caballus
ccgucuuacccagcaguguuugggugcugguugggagucucuaauacugccggguaaugaugga

SEQ ID NO: 3214 - RNA, 68 nt, Equus caballus
uggacuucccuuugucauccuaugccugagaauauaugaaggaggcugggaaggcaaagggacguuca

SEQ ID NO: 3215 - RNA, 69 nt, Equus caballus
cucuuguccuucauuccaccggagucugucucauacccaaccagauuucaguggagugaaguucaggag

SEQ ID NO: 3216 - RNA, 69 nt, Equus caballus
aggccacaugcuucuuuauauccccauacggauuacuuugcuauggaauguaaggaagugugugguuuc

SEQ ID NO: 3217 - RNA, 83 nt, Equus caballus
uuccugugacgggcgagcuuuuggcccggguuauaccugaugcucacguauaagacgagcaaaaagcuuguuggucagaggag

SEQ ID NO: 3218 - RNA, 77 nt, Equus caballus
ccucucagggaagcuuuuugcucgcguuauguuucucauccgaauauaagacgaacaaaagguuugucugagggcag

SEQ ID NO: 3219 - RNA, 87 nt, Equus caballus
ugugacuugugggcuucccuuugucauccuuugccuagggcucugaguggggcagggacugcaaaggggugcucaguugucaccucu

SEQ ID NO: 3220 - RNA, 60 nt, Equus caballus
ccuuggcucuagacugcuuacugcccgggccgcccucaguaacagucuccagucacggcc

SEQ ID NO: 3221 - RNA, 65 nt, Equus caballus
ucugccugucuacacuugcugugcagaacauccgcucaccuguacagcaggcacagacaggcagu

SEQ ID NO: 3222 - RNA, 110 nt, Equus caballus
aucauuaagaaaugguauacaggaaaaugaccuaugaauugacagacaauaugacuaaguuugucugucauuucuguaggccaauauucuguauaucucugcuacuucaa

SEQ ID NO: 3223 - RNA, 58 nt, Equus caballus
uaaucucagcuggcaacugugagauguucauaaauccccacaguggucucugggauua

SEQ ID NO: 3224 - RNA, 86 nt, Equus caballus
guggcagacuggaaaaucucugcaggcaaaugugaugucacuaaagaaaucacacacuuacccguagagauucuacagucugacau

SEQ ID NO: 3225 - RNA, 57 nt, Equus caballus
uacugcaucaggaacugauuggauaagaaucagucaccaucaguuccuaaugcauug

SEQ ID NO: 3226 - RNA, 62 nt, Equus caballus
uugugcuugaucuaaccaugugguugccagguaugaguaaaacaugguuccgucaagcacca

SEQ ID NO: 3227 - RNA, 63 nt, Equus caballus
uugugcuugaucuaaccaugugguggcacgauggaaacggaacaugguucugucaagcaccgc

SEQ ID NO: 3228 - RNA, 87 nt, Equus caballus
gggccgcggcucuugauuguccaaacgcaauucucgagucucuggcuccggccgagaguugagucuggacgucccgagccgccgccc

SEQ ID NO: 3229 - RNA, 97 nt, Equus caballus; identical to SEQ ID NO: 142

SEQ ID NO: 3230 - RNA, 110 nt, Equus caballus
ccaacauccaggucuggggcaugaaccuggcauacaauguagauuucuguguuucuugggcaacagcuacauugucugcuggguuucaggcuaccuggaaacauguucuc

SEQ ID NO: 3231 - RNA, 110 nt, Equus caballus
gcugcuggaaaguguagguacccucaauggcucaguagccaguguagauccugucuuuuguaaucagcagcuacaucuggcuacugggucucugauggcaucuucuagcu

SEQ ID NO: 3232 - RNA, 104 nt, Equus caballus
gcccagccuccugcagugccacgcuccguguauuugacaagcugaguuggacacuccaugugguagagugucaguuugucaaauaccccaagugcggcacaugc

SEQ ID NO: 3233 - RNA, 81 nt, Equus caballus
gggcuuucaagucacuagugguuccguuuaguagaugguugugcauuguuucaaaauggugcccuagugacuacaaagccc

SEQ ID NO: 3234 - RNA, 78 nt, Equus caballus
aggacucuuccggagggccccccccaauccuguuguguuugauucagaggguuggguggaggcuuuccugaaggcucu

SEQ ID NO: 3235 - RNA, 63 nt, Equus caballus
aagaaaugguuuaccgucccacauacauuuugaguauguaugugggaugguaaaccgcuucuu

SEQ ID NO: 3236 - RNA, 86 nt, Equus caballus; identical to SEQ ID NO: 170

SEQ ID NO: 3237 - RNA, 97 nt, Equus caballus
ccuccugcuggccgcaggugcugugacgauguugcacuacugugcucugagaagcagugcaaugauauugucaaagcaucugggacuagccuugggg

SEQ ID NO: 3238 - RNA, 68 nt, Equus caballus
ccaccacuuaaacguggauguacuugcuuugaaacuauaaaaguaagugcuuccauguuuuagugaug

SEQ ID NO: 3239 - RNA, 76 nt, Equus caballus
acucucuuuaacuuuaacauggacgugcuuucugugacuugcaaaauaguaagugcuuccauguuuuaguagaagu

SEQ ID NO: 3240 - RNA, 68 nt, Equus caballus
ccuuugcuuuaacauggggguaccugcuguguaaagcaaaaguaagugcuuccauguuucaguggagg

SEQ ID NO: 3241 - RNA, 68 nt, Equus caballus
ccucuacuuuaacauggaggcacuugcugugacuugagaaaaauaagugcuuccauguuuuagugugg

SEQ ID NO: 3242 - RNA, 86 nt, Equus caballus; identical to SEQ ID NO: 194

SEQ ID NO: 3243 - RNA, 83 nt, Equus caballus; identical to SEQ ID NO: 196

SEQ ID NO: 3244 - RNA, 95 nt, Equus caballus
cucgucugucuguugggcuggaggcagggccuuugugaaggcgaguugugcugggaucgccucugggcccuuccuccagcccagaggcggauuca

SEQ ID NO: 3245 - RNA, 71 nt, Equus caballus
ggagcgggggggcaggaggggcucagggagaaagugugugcagccccuggcccucucugcccuuccguccc

SEQ ID NO: 3246 - RNA, 98 nt, Equus caballus
guguuaaucagugguaccugaagagagguuuucuggguuucuguuucuuuaaugaagaugaaacacaccuaguuaaccucuuuuccaguaucagaucc

SEQ ID NO: 3247 - RNA, 64 nt, Equus caballus
ucucugggccugugucuuaggcucuucaaagaucaaccgagcaaaagcacacggccugcagaga

SEQ ID NO: 3248 - RNA, 92 nt, Equus caballus
gaauuugguuuuguuuggguuuguucuagguauggucccagggaucccagaucaaaccaggccccugggccuauccuagaaccaaccuaaac

SEQ ID NO: 3249 - RNA, 75 nt, Equus caballus
gagcgggggucaagagcaauaacgaaaaauguuugucauaaaccguuuuucauuauugcuccugaccuccucuca

SEQ ID NO: 3250 - RNA, 92 nt, Equus caballus
guagucaguagguggggggugagaacggcuucauacaggagcugaugcgcaguuacccagcuccuaugagaugccuuuccucaccccuucac

SEQ ID NO: 3251 - RNA, 59 nt, Equus caballus
caacaauauccuggugcugagugaugacacacgcaacuccagcaucagugauuuuguug

SEQ ID NO: 3252 - RNA, 67 nt, Equus caballus
gguuauaaagcaaugagacugauugucaugugucgcuugugggauccgucucaguuacuuuauagcc

SEQ ID NO: 3253 - RNA, 99 nt, Equus caballus
gaaccugggcucaaggugaggggugcuaucugugauugagggacauggcaaauagaauugucucacacagaaaucgcacccgucaccuuggcccgccua

SEQ ID NO: 3254 - RNA, 96 nt, Equus caballus
acccaaccccaggucugcugacuccuaguccagugcucgugauggcuagugggcccugaacuaggggucuggaggccuggguuugaauaucgccag

SEQ ID NO: 3255 - RNA, 95 nt, Equus caballus; identical to SEQ ID NO: 213

SEQ ID NO: 3256 - RNA, 96 nt, Equus caballus
aaacccuuugcuccuauaagaguaaagugcacgcgcuuugggacagugaggaagaugauguucacaaagcccauacacuuuuacucuuuaggagag

SEQ ID NO: 3257 - RNA, 71 nt, Equus caballus
ggagcuuaucagaaucuccagggguacugauaauuuuaaaaagucccccaggcgugauucugauuugcuuc

SEQ ID NO: 3258 - RNA, 66 nt, Equus caballus
ucucgaauccuuggaaccuaggugugagugccauuucagugcaacacaccuauucaaggauucaaa

SEQ ID NO: 3259 - RNA, 75 nt, Equus caballus
uguugucggguggaucacgaugcaauuuugauuaguauaauaggagaaaaauugcacgguauccaucuguaaacc

SEQ ID NO: 3260 - RNA, 66 nt, Equus caballus
aaugagggacuuucaggggcagcuguguuuucugacucagucauaaugccccuaaaaauccuuauu

SEQ ID NO: 3261 - RNA, 87 nt, Equus caballus; identical to SEQ ID NO: 220

SEQ ID NO: 3262 - RNA, 68 nt, Equus caballus
ccaucacuguugcuaauaugcaacucuguucaauacaaacuggaauugcacuuuagcaauggugacgg

SEQ ID NO: 3263 - RNA, 70 nt, Equus caballus
uugaagggagaucgaccgugucauauucgcuuuauugacuucgaauaauacaugguugaucuuuucucgg

SEQ ID NO: 3264 - RNA, 75 nt, Equus caballus
agacagagaggccaggucacgucucugcaguuacacagcucaugagugccugcugggguggaaccuggucugucu

SEQ ID NO: 3265 - RNA, 60 nt, Equus caballus
acucaaacugugggggcacuuucugugcuacguagggaagugccgccauuuuuugagugu

SEQ ID NO: 3266 - RNA, 72 nt, Equus caballus
uacaucggccauuauaauacaaccugauaaguguuacagcacuuaucagguuguauuguaauugucugugua

SEQ ID NO: 3267 - RNA, 72 nt, Equus caballus
acucggauggauauaauacaaccugcuaaguguccuagcacuuaucagguuguauuaucauuguccgugucu

SEQ ID NO: 3268 - RNA, 68 nt, Equus caballus
uaaaagguagauucuccuucuaugaguacaauauuuaugauuaaucauagaggaaaauccacguuuuc

SEQ ID NO: 3269 - RNA, 82 nt, Equus caballus
ugguauuuaaaagguggauauuccuucuauguuuacgugauucauagauaaucauagaggaaaauccauguuuucaguauca

SEQ ID NO: 3270 - RNA, 66 nt, Equus caballus
aaaagguggauauuccuucuauguuuauguuguuuaugguuaaacauagaggaaauuccacguuuu

SEQ ID NO: 3271 - RNA, 69 nt, Equus caballus; identical to SEQ ID NO: 237

SEQ ID NO: 3272 - RNA, 66 nt, Equus caballus
agggcuccugacuccagguccuguguguuaccucgaaauagcacuggacuuggagucagaaggccu

SEQ ID NO: 3273 - RNA, 67 nt, Equus caballus
agagaugguagacuauggaacguaggcuuuaugauuuuugaccuauguaacaugguccacuaacucu

SEQ ID NO: 3274 - RNA, 61 nt, Equus caballus
aagacgguugaccauagagcaugcgcugucucuaggucguauguaauaugguccacgucuu

SEQ ID NO: 3275 - RNA, 75 nt, Equus caballus; identical to SEQ ID NO: 2970

SEQ ID NO: 3276 - RNA, 76 nt, Equus caballus; identical to SEQ ID NO: 252

SEQ ID NO: 3277 - RNA, 73 nt, Equus caballus; identical to SEQ ID NO: 253

SEQ ID NO: 3278 - RNA, 88 nt, Equus caballus
uguuaaaucaggaguuguaaacaauuccuaggcaauguguauaauguuuguaagucauuccuagaaauuguucacaaugccuguaaca

SEQ ID NO: 3279 - RNA, 79 nt, Equus caballus; identical to SEQ ID NO: 255

SEQ ID NO: 3280 - RNA, 74 nt, Equus caballus
ugaggagagguugucugugaugaguucgcuuuauuaaugacgaauauaacacagauggccugucuucaguacca

SEQ ID NO: 3281 - RNA, 82 nt, Equus caballus
ugguacuuggagagauaguagaccguauagcguacgcuuuaucugugacguauguaacacgguccacuaacccucaguauca

SEQ ID NO: 3282 - RNA, 80 nt, Equus caballus
ggguacaggagggauggucgaccaguuggaaaguaauuguuucuaauguacuucaccugguccacuagccguccguaccc

SEQ ID NO: 3283 - RNA, 79 nt, Equus caballus
cacauuguaggccucauuaaauguuuguugaaugaaaaaaugaaucaucaacagacauuaauugggcgccugcucugug

SEQ ID NO: 3284 - RNA, 63 nt, Equus caballus
aggcugaggggcagagagcgagacuuuucuauuuuccaaaagcucggucugaggccccucagu

SEQ ID NO: 3285 - RNA, 98 nt, Equus caballus
cgaggggaugcagcagcaauucauguuuugaagugauuuaaacgguucaaaacgugaggcgcugcuauacccccucgcggggaaguuggaaggugggg

SEQ ID NO: 3286 - RNA, 67 nt, Equus caballus
gggcgucuuaccagacacgguuagaucugcguccuucugucuaauacugucugguaaugccguccau

SEQ ID NO: 3287 - RNA, 89 nt, Equus caballus
cguccugcgaggugucuugcaggccgucaugcaggccacacugacgguaacguugcaggucgucuugcagggcuucucgcaagacgaca

SEQ ID NO: 3288 - RNA, 89 nt, Equus caballus
ugcgugacuccuccaggucuuggaguaggucauuggguggauccuuuauuucccuaugugggccacuggauggcuccuccaugucuugg

SEQ ID NO: 3289 - RNA, 124 nt, Equus caballus
ugcccggggagaaguacggugagccugucauuauucagagaggcuagauccucuguguuaagaaggaucaugaugggcuccucgguguucuccagguagcggcaccacaccaugaaggcagccc

SEQ ID NO: 3290 - RNA, 109 nt, Equus caballus
ggcggggagguugaacauccugcauagugcugccaggaaauccccauuuuauacuaagagggggcuggcugguugcauauguaggaugucccaucuccccgcccgcuuc

SEQ ID NO: 3291 - RNA, 60 nt, Equus caballus
uggcaguguauuguuagcugguugaauauaugaauggcaucagcuaacaagcaacugcua

SEQ ID NO: 3292 - RNA, 91 nt, Equus caballus
gaaagaugcuaaacuguuuuugcgauguguuccuaauaugcaguauaaauauauugggagcauuuugcaugcaugguuuuguaucaauaua

SEQ ID NO: 3293 - RNA, 79 nt, Equus caballus
uacaaaauuauuuuugcaauauguuccugaauauguaauauaaguguauugggaacauuuugcauccauaguuuuguau

SEQ ID NO: 3294 - RNA, 89 nt, Equus caballus
gaaagaugcucaacuauuuuugcgauguguuccuaauacguaauauaaauguauugggaacauuuugcauucauaguuuuguaucaaua

SEQ ID NO: 3295 - RNA, 72 nt, Equus caballus
cuugggaaugucgaggaaaccguuaccauuacuguguuuaguaaugguaacgguucucuugcuguacccaga

SEQ ID NO: 3296 - RNA, 69 nt, Equus caballus
agaacccuaucgauauugucucugcuguguaaaucgcucugaguagugcaauauugcuuauaggguuuu

SEQ ID NO: 3297 - RNA, 73 nt, Equus caballus
acuugaagagaggcuggccgugaugaauucgauucaucaaagcgagucauacacggcucuccucucuuuuagu

SEQ ID NO: 3298 - RNA, 66 nt, Equus caballus
ggauccuguacugagcugccccgaggcccuucacugugcccagcucggggcagcucaguacaggau

SEQ ID NO: 3299 - RNA, 80 nt, Equus caballus; identical to SEQ ID NO: 2994

SEQ ID NO: 3300 - RNA, 84 nt, Equus caballus
uugguacuuggagagugguuaucccuguccuguucguuuuaauuacgucgaaucguacagggucauccacuuuuucaguaucaa

SEQ ID NO: 3301 - RNA, 83 nt, Equus caballus
gagaaucaucucucccagauaauggcacucucaaacaaguuuccaaguuguuugaaaggcuauuucuuggucagaagacucuc

SEQ ID NO: 3302 - RNA, 85 nt, Equus caballus
guggcagcuugguggucguauguguggcgccauuuauuugaccccuuuaggagugacaucacauauacggcggcuaaacugcuac

SEQ ID NO: 3303 - RNA, 69 nt, Equus caballus
ucgacaccauggaucuccaggugggucacguuuagagauacaccaaccuggaggacuccaugcuguuga

SEQ ID NO: 3304 - RNA, 84 nt, Equus caballus
uugacuuagcuggguaguggggaacccuuccaugaggaguagaacacuccuuaugcaagauucccuucuaccugacuggguugg

SEQ ID NO: 3305 - RNA, 66 nt, Equus caballus
gaggagcugcgggacaagauucuuggggccaccauugagaacuccaagauuguucugcagaucgac

SEQ ID NO: 3306 - RNA, 62 nt, Equus caballus
aggagcugcgggacaagauucuuggggccaccauugagaacuccaagauuguucugcagauc

SEQ ID NO: 3307 - RNA, 70 nt, Equus caballus
ccugggaugcaggcgaguuaggagaaaucuaacaaucgauaaauauuccuugggucuacugugugccagg

SEQ ID NO: 3308 - RNA, 89 nt, Equus caballus
cuggccuccagggccuuguacaugguaggcuuucauucauucguuugcacauucggugaaggucuuccgugugccaggcucugugccag

SEQ ID NO: 3309 - RNA, 81 nt, Equus caballus; identical to SEQ ID NO: 309

SEQ ID NO: 3310 - RNA, 82 nt, Equus caballus
uggucccugaaaagaaguugcccauguuauuuucgcuugauaugugacgaaacaaacauggugcacuucuuuuucgguauca

SEQ ID NO: 3311 - RNA, 103 nt, Equus caballus
acccuagccagguacucgaauggagguuguccaugguguguucauuuuauuuaugaugaguauuacauggccaaucuccuuucaguacuaaauucuucuuggg

SEQ ID NO: 3312 - RNA, 59 nt, Equus caballus
cagcagcacacugugguuuguacggcacuguggccacguccaaaccacacugugguguu

SEQ ID NO: 3313 - RNA, 123 nt, Equus caballus
uguucuguccccugcacccugggcgggcggcuguuaagacuugcagugauguuuaacuccucuccacgugaacaucacagcaagucugugcugcuucccguccccaugcugccugggcagggu

SEQ ID NO: 3314 - RNA, 84 nt, Equus caballus
gcucccccucucuaauccuugcuaccugggugagaguguugucugaaugcaaugcaccugggcaaggauuccgagagcgagagc

SEQ ID NO: 3315 - RNA, 84 nt, Equus caballus
gcucccccucucuaauccuugcuaccugggugagagugcuuucugaaugcaaugcaccugggcaaggauuccgagagggagagu

SEQ ID NO: 3316 - RNA, 84 nt, Equus caballus
gcucucccucucucauccuucgucccugggugagagugcuuuccgaaugcaaugcaccugggcaaggauuccagagggcgaggc

SEQ ID NO: 3317 - RNA, 80 nt, Equus caballus
ugcucccccucucuaauccuugcuaucugggugcuagugcugucucaaugcaaugcaccugggcaaggauucagagaggg

SEQ ID NO: 3318 - RNA, 71 nt, Equus caballus
ugcccuagcagcgggaacaguacugcagugggcgaucggugcucuggaguauuguuccugcugcccgggca

SEQ ID NO: 3319 - RNA, 83 nt, Equus caballus; identical to SEQ ID NO: 3009

SEQ ID NO: 3320 - RNA, 84 nt, Equus caballus; identical to SEQ ID NO: 322

SEQ ID NO: 3321 - RNA, 95 nt, Equus caballus
cauguugugugcagugcuccacuucaggaagugccauccauguggcuagaaauaugauuggcaccucuuagagugaaguaaugcacaacagguac

SEQ ID NO: 3322 - RNA, 117 nt, Equus caballus
accacucucagcuggguguagugcccuacuccagagggugucauucacauagacuaaagcaugauugucaccuuuuggaguagaguaauacacaucauggacgauauaugugguggc

SEQ ID NO: 3323 - RNA, 98 nt, Equus caballus
cauacugugugugguacccuacugcagacaguggcaaucauguauaauuaaaaaugauugacaccucugcaaguguaguaacacaugacacaugagau

SEQ ID NO: 3324 - RNA, 89 nt, Equus caballus
uucuuuuugugguacccuacuccagagaauggcaaucauguauaacuaaaugugauugacaccucugugaguggaauaaugcaugacuu

SEQ ID NO: 3325 - RNA, 90 nt, Equus caballus
gauuugcuuucucucuuacaugccuugaguguaggaccguuggcaucuuaauuacccucccacacccaaggcuugcaggagggcaagccu

SEQ ID NO: 3326 - RNA, 78 nt, Equus caballus
auacuugaggagaaauuauccuugcuguguucgcuuuauuugugaugaaucauacaaggacaauuucuuuuugaguau

SEQ ID NO: 3327 - RNA, 84 nt, Equus caballus
acgucagggaaaggauucugcugucggucccacuccagaguucgcaaaauggguggugggcacagaauccagucucugcuugug

SEQ ID NO: 3328 - RNA, 86 nt, Equus caballus
aggaccucagacaucucggggaucaucaugucacgagauaccacugugcacuugugacagauugauaacugaaaggucugggagcc

SEQ ID NO: 3329 - RNA, 72 nt, Equus caballus
cuuaaggagaaguugcccguguuuuuuucgcuuuauuugugacgaaacauucgcggugcacuucuuuuucag

SEQ ID NO: 3330 - RNA, 90 nt, Equus caballus
auuuucaucaccuagggaucuuguuaaaaggcagauucugauucagggaccaagauucugcauuuuuagcaaguucccaagugaugcuaa

SEQ ID NO: 3331 - RNA, 76 nt, Equus caballus
ggcaucuuguuaaaacgcagacuuggauucagcaggucugggaugaggcccaagauucugcauuuuuaacaaguuc

SEQ ID NO: 3332 - RNA, 106 nt, Equus caballus
cccagccuggcacauuaguaggccucaguaaauguuuauuggaugaauaaaugaaugacucaucaacaaacauuuauugugugccugcuaacgugaucuccacagg

SEQ ID NO: 3333 - RNA, 62 nt, Equus caballus
uggaaauccagagugggugaggccugucugaccauuucuaggcgacccacucuugguuucca

SEQ ID NO: 3334 - RNA, 62 nt, Equus caballus
augaaaucaagcgugggugagaccuggugcagaacgggaaggcgacccauacuugguuucag

SEQ ID NO: 3335 - RNA, 61 nt, Equus caballus
auguauaaauguauacacacuuccuauauauauccauauauauaguguauauauuauacau

SEQ ID NO: 3336 - RNA, 68 nt, Equus caballus
uuugguuacaguuguucaaccaguuacuaaucuaacuaauuguaaccgguugaacaacugaacccaaa

SEQ ID NO: 3337 - RNA, 81 nt, Equus caballus
caaucagaaacgagcuuauucauaaaaguacaguauaauccaguaaaccuguaauuuuauguauaagcuagucucugauug

SEQ ID NO: 3338 - RNA, 83 nt, Equus caballus
uuaugccaugacauugugucaauaugcgaugaugugugugauggcacagcgucaucacguggugacgcaacaucaugacguaa

SEQ ID NO: 3339 - RNA, 73 nt, Equus caballus
ugaugcuggcagugaugccgauggugcgggcuggaaauggggugcuacgucaucguugucaucgucaucauca

SEQ ID NO: 3340 - RNA, 97 nt, Equus caballus
acgcgggaggggcgggagggggguccccggugcucggaucucgagggugcuuauuguucgguccgagccugggucucccucucccccccuccucagc

SEQ ID NO: 3341 - RNA, 95 nt, Equus caballus; identical to SEQ ID NO: 541

SEQ ID NO: 3342 - RNA, 65 nt, Equus caballus
guggcugacgggaggcggagcagcgaacgagggcgucggccauuuugugccuguuuccuguggga

SEQ ID NO: 3343 - RNA, 98 nt, Equus caballus; identical to SEQ ID NO: 566

SEQ ID NO: 3344 - RNA, 85 nt, Equus caballus
ucauuccuucaguguugaaacaaucucugcugaaccaggcuccaaacuacguucacuggaguuuguuucaauauugcaagaauga

SEQ ID NO: 3345 - RNA, 97 nt, Equus caballus
aacuguucaaggauauuugaggagagguuauccguguuauguucgcuucauucaucaugaauaauacaugguuaaccucuuuuugaauaucagacuc

SEQ ID NO: 3346 - RNA, 78 nt, Equus caballus
cugaaauagguugccugugagguguucacuuucuauacgaugaauauuauacagucaaccucuuuccggaaucgaauc

SEQ ID NO: 3347 - RNA, 97 nt, Equus caballus
cugcuccuucuccuguacccauugcauaucggaguugugaauucugaaagcaccuccugugugcauggauuacaggagggcgagccuugucaucaug

SEQ ID NO: 3348 - RNA, 74 nt, Equus caballus
gaacauugaaacaggcuaggaaaacugauuggauagaaaauauuacucuauucauuuaucuccuagccuacaaa

SEQ ID NO: 3349 - RNA, 100 nt, Equus caballus
gguuuagggguggaucugacgucccugaguguauguggugaaccugaauuugccuuggguuuccucauauucauucaggagugucaguucccccuucacu

SEQ ID NO: 3350 - RNA, 84 nt, Equus caballus
ggccaggaagaggaggaagcccuggaggggcuggaggugauggauguuuuccuccgguucucagggcuccaccucuuccgggcc

SEQ ID NO: 3351 - RNA, 100 nt, Equus caballus
gauggcgaucuagcccuuuaguuuugagguugguguacugugugugaguauauauauuuaucacacauaggcaauaucuuugaaagugagggugcacguc

SEQ ID NO: 3352 - RNA, 73 nt, Equus caballus
cccaggggcuggcgcggagagggcccacagugcacucagugacacuguaugccuucaccgcucagccccuggg

SEQ ID NO: 3353 - RNA, 86 nt, Equus caballus
guagggcaaucugucuuuaggaagggauagauuacucuaaaagaaaugaauccgagauaguuuucccuucaauucaggcauguugu

SEQ ID NO: 3354 - RNA, 64 nt, Equus caballus
uaaaaccuucagaaggaaaggagaauguuuuguggaccauuugguuuuuuguguggcaguuuua

SEQ ID NO: 3355 - RNA, 93 nt, Equus caballus
gguaacugcccucaaggagcuuacaaucuagcuggggguaaaugacuugcacaugaacgcaacuagacugugagcuucuagagggcaggggcc

SEQ ID NO: 3356 - RNA, 61 nt, Equus caballus
acuuuaagucucuuuucagggugccacaggcaaagcuggggacccagggagagacguaagu

SEQ ID NO: 3357 - RNA, 85 nt, Equus caballus
gccuggguacaugagaugguugaccagagagcacacgcuuuauuugugccguuugugaccugguccacuaacccucaguaucuaa

SEQ ID NO: 3358 - RNA, 63 nt, Equus caballus
aggaggagcagcagggugaaacugacacaguucuggugaguuucacuuugcugcuccuccuga

SEQ ID NO: 3359 - RNA, 120 nt, Equus caballus
aaugacggaggugcaggcauuuccugaggauuaaugaccagcugggaggaaccaguggcccuuggcucugccucccggccagccauuaauuccaaggaaaugucuuuugcugaagucguu

SEQ ID NO: 3360 - RNA, 109 nt, Equus caballus
auuuucgaucuaaaaucuaggaggcaggugcucacuuguccuccuccaugcuugggaaauacagggaggaggccauaguggcaacugucaccaugauugauuuccuugg

SEQ ID NO: 3361 - RNA, 108 nt, Equus caballus
gcuuuuguauuauagguuuuugcucaugcaccaugguugucugagcaugcagcaugcuugucugcucauacuccaugguuccugagcaggaaccuucauugccuacug

SEQ ID NO: 3362 - RNA, 79 nt, Equus caballus
gcccucugcccggagaccucuggguucugagcugugacguggcuucggagcugggaucucgggggucuugguucagggu

SEQ ID NO: 3363 - RNA, 93 nt, Equus caballus
gcccggaaaccucuggguucugagcugugacguggcuucugagcugggaucucgggggucuugguucaugguuugggucucuggguucugggc

SEQ ID NO: 3364 - RNA, 95 nt, Equus caballus
gccgcccuuccgugccuccagcaccacgugucugggccaugugagcaaggucacaugggcccgauguggugcugggggcggcagggcucugcucu

SEQ ID NO: 3365 - RNA, 93 nt, Equus caballus
uucuauuauuugcaaucaguaacaaagauucauccuuguguccaucaagcaacaaggagaaucuuugucacuuaguguaauuaauagcugcgc

SEQ ID NO: 3366 - RNA, 80 nt, Equus caballus
uacuuguuagaagguuacuuguuaguucaggaccucguuauuucuugccugaacuuugcaguagccuccuaacuggucuc

SEQ ID NO: 3367 - RNA, 77 nt, Equus caballus; identical to SEQ ID NO: 603

SEQ ID NO: 3368 - RNA, 60 nt, Equus caballus
gcggccccacgcaccaggguaagagagacucucgcuuccugcccuggcccgagggaccga

SEQ ID NO: 3369 - RNA, 81 nt, Equus caballus
ugaagugcuguggauuucuuugugaaucaccauaucugagcuaaugugguggugguuuacaaaguaauucauagugcuuca

SEQ ID NO: 3370 - RNA, 74 nt, Equus caballus; identical to SEQ ID NO: 3050

SEQ ID NO: 3371 - RNA, 78 nt, Equus caballus
gugcuuaaagaauggcugucuguaguauggucuccauauucauggugauuaauaucggacaaccauuguuuuaguauc

SEQ ID NO: 3372 - RNA, 86 nt, Equus caballus
gaaagggagaagcauucuuucauugguugguguguauugccucgucagccaaucagaggaugccauuuauccuuuucugacuagcu

SEQ ID NO: 3373 - RNA, 70 nt, Equus caballus
gucugccuggcccacccagccgggaauagugcacgaguuuguuuccggcucgagugggugugucggaggc

SEQ ID NO: 3374 - RNA, 86 nt, Equus caballus
uuugguacuugaagagaggauacccuuuguauguucacuucauuaaugacgaauauacagggggagacucuuauuugcguaucaaa

SEQ ID NO: 3375 - RNA, 121 nt, Equus caballus
ugaagggacuguagugccauccacucugcaggguagcugaggggaugguagaccggugacgugcacuucauuuaugauguaggucacccguuugacuauccaucagcacccaguccaucug

SEQ ID NO: 3376 - RNA, 120 nt, Equus caballus
gggagagaggcugggucagcgucacuucaugguauuugaagaugcgguugaccaugcuguguacgcuuuauuuaugacguaggacacauggucuacuucuccucaauaucacaucucgcc

SEQ ID NO: 3377 - RNA, 67 nt, Equus caballus
gccucguggccugguccccacuauuugagaagagucacaucucggaggugaggaccgccucguggua

SEQ ID NO: 3378 - RNA, 71 nt, Equus caballus
aaccauuccaguaacuuucuuugcauauguacuuagcuguacuaugagugguugguuuguaugagaugguu

SEQ ID NO: 3379 - RNA, 93 nt, Equus caballus
uccuucuuguauaagcacugugcuaaaauugcagaaacuaggaucacuucuugguuuuuguaauaaugcuagcagaguacacacaagaagaaa

SEQ ID NO: 3380 - RNA, 63 nt, Equus caballus
uacggauaagcaaagaaagugguuucuuuaaauggaaacuacuccuggugaagaugcugugaa

SEQ ID NO: 3381 - RNA, 85 nt, Equus caballus
ugcuguggauuaggcuuuggcuuaagggaauauuguggcugauuugaucuucuauccagaccacugaagcuuucuccauaucagc

SEQ ID NO: 3382 - RNA, 69 nt, Equus caballus
agguccucaauaaguauuuguugaaagaauaaaugaaccaacaagucuuauuugagcaccuguuaugug

SEQ ID NO: 3383 - RNA, 57 nt, Equus caballus
cuuggcaccucguaagcacucaguaaauacuuguugagugccugcugugugccaggc

SEQ ID NO: 3384 - RNA, 101 nt, Equus caballus; identical to SEQ ID NO: 724

SEQ ID NO: 3385 - RNA, 88 nt, Equus caballus
uuaaaaugugcauuucuuggacuuaccccagaucuaaucuguugaacuaaaaucucagaggcuggaguccaggaaucugcauuuuuaa

SEQ ID NO: 3386 - RNA, 87 nt, Equus caballus
ggugggauaccgguggcccugacugaagaccagcaguuaugcuauagcuguugguuucgagcagaggcccaaaggacugucuuccca

SEQ ID NO: 3387 - RNA, 56 nt, Equus caballus
aggcccugaaucaagaccagcaguuugcuguggcuguugguuucaagcaggagccg

SEQ ID NO: 3388 - RNA, 92 nt, Equus caballus
accuaccuaacuggguuagggcccuggcuccaucuccuuuaggaaaaccuucuuuggggaguggggcuucgacccuaacccagcugggcugu

SEQ ID NO: 3389 - RNA, 111 nt, Equus caballus
aagaugaggaguuaagaguucauucggcuguccagauguauccaaguacccaguuauuuggcaauaaauacaucugggcaacugauugaacuuuucgcuuuucaugacuca

SEQ ID NO: 3390 - RNA, 72 nt, Equus caballus
uguggggggucacucuaggcaccgcagcacugugcuggggauguugcagcugccugggagugauuucacaca

SEQ ID NO: 3391 - RNA, 58 nt, Equus caballus
aauuuuucaguacaauaugucucaugcaacauuugggacauacuuauacuaaaauauu

SEQ ID NO: 3392 - RNA, 134 nt, Equus caballus
gaaugcccgguuaaauuucaauuucaaaucaacaaugaauaauuuuuuaaucuaaguaugucccaugcaauauuugggacauacuuauacuagaacauuauuguugauaugaaauucaaauuuaauuggacguc

SEQ ID NO: 3393 - RNA, 122 nt, Equus caballus
caguuaaauuugaauuucugggaaacaaugaauaauuuuuuaguguaaguauaucccaugcaauauuugcgacauacuuauacuaaaaauaaugcuuguuuguuugaaauucagauguaacu

SEQ ID NO: 3394 - RNA, 104 nt, Equus caballus
uuggaauuuagacaaauaaugaagaauuuuuuaguguaaguaugucuuaugcaauauuugggacauacuuaugcuaaaaaauuuauuaguuaucugaaauucaa

SEQ ID NO: 3395 - RNA, 52 nt, Equus caballus
uuuaguauaaguauacacccccaugcaauguuugggauauacuuauacuaaa

SEQ ID NO: 3396 - RNA, 55 nt, Equus caballus
uuuuuuaguauagguaugucccaugcaauguuugggauauacuuauacuaaaaaa

SEQ ID NO: 3397 - RNA, 56 nt, Equus caballus
aucucuacggguaagugugugauuucuuuagugacaucacauuugccugcagagau

SEQ ID NO: 3398 - RNA, 86 nt, Equus caballus
ggugggugguuucuccguuugccuguuuugcugauguucuuuugauucauucucagcaaaauaagcaaauggaaaauucauccauc

SEQ ID NO: 3399 - RNA, 73 nt, Equus caballus
uuuuauuacgugcuuccagagcucuucauugugguuucagcaauaugaggagcucugcgagcauguaauaaaa

SEQ ID NO: 3400 - RNA, 60 nt, Equus caballus
aagguagauagaacaggucuuguuugcaaaauaaauucaagaccuacuuaucuaccaaca

SEQ ID NO: 3401 - RNA, 60 nt, Equus caballus
uggcucugugaggucggcucaaggugggucuggauauugagcaggccugucagggcguug

SEQ ID NO: 3402 - RNA, 80 nt, Equus caballus
uggauauauuucuacucuugauuaaaguuuuguaagaaacaauacaggauuuggggugggggauggggagggaggauauu

SEQ ID NO: 3403 - RNA, 61 nt, Equus caballus
aggucaagguucacaggggaucaagaaauauuauucuuguauaaucuguuuacuuugaccu

SEQ ID NO: 3404 - RNA, 80 nt, Equus caballus
guuucuuuggggaguguuugcuauauaauuggauuuauacaauguuuagaggugcaguaggcaugacuuugaguagauaa

SEQ ID NO: 3405 - RNA, 68 nt, Equus caballus
gucugcuguuggaugcgcuugaucguggcgcccuugggccccaccacgagcccuaccacgcgguaggg

SEQ ID NO: 3406 - RNA, 64 nt, Equus caballus
cugcugcuggaugcgcuugaugguugcccccuuggggcccaccaccagccccacuacgcgguag

SEQ ID NO: 3407 - RNA, 83 nt, Equus caballus
cgugugcguccgcugcuggaugcgcuugaugguggcgcccuugggccccaccaccagccccaccacgcgguagggcacacgca

SEQ ID NO: 3408 - RNA, 80 nt, Equus caballus
cucuaggaugugcucauugcaugggcuguguauauuuuuauucaauacccagagcgugcagugugaacauaauagagauu

SEQ ID NO: 3409 - RNA, 94 nt, Mus musculus
uucacugugggaugagguaguagguuguauaguuuuagggucacacccaccacugggagauaacuauacaaucuacugucuuuccuaaggugau

SEQ ID NO: 3410 - RNA, 96 nt, Mus musculus
cugcauguucccagguugagguaguagguuguauaguuuagaguuacaucaagggagauaacuguacagccuccuagcuuuccuugggacuugcac

SEQ ID NO: 3411 - RNA, 85 nt, Mus musculus
gcagggugagguaguagguugugugguuucagggcagugauguugccccuccgaagauaacuauacaaccuacugccuucccuga

SEQ ID NO: 3412 - RNA, 94 nt, Mus musculus
ugugugcauccggguugagguaguagguuguaugguuuagaguuacacccugggaguuaacuguacaaccuucuagcuuuccuuggagcacacu

SEQ ID NO: 3413 - RNA, 95 nt, Mus musculus
acggccuuuggggugagguaguagguuguaugguuuugggcucugccccgcucugcgguaacuauacaaucuacugucuuuccugaaguggccgc

SEQ ID NO: 3414 - RNA, 103 nt, Mus musculus
aauggguuccuaggaagagguaguagguugcauaguuuuagggcagagauuuugcccacaaggaguuaacuauacgaccugcugccuuucuuagggccuuauu

SEQ ID NO: 3415 - RNA, 93 nt, Mus musculus
cgcgccccccgggcugagguaggagguuguauaguugaggaagacacccgaggagaucacuauacggccuccuagcuuuccccaggcugcgcc

SEQ ID NO: 3416 - RNA, 89 nt, Mus musculus
aucagagugagguaguagauuguauaguugugggguagugauuuuacccuguuuaggagauaacuauacaaucuauugccuucccugag

SEQ ID NO: 3417 - RNA, 83 nt, Mus musculus; identical to SEQ ID NO: 9

SEQ ID NO: 3418 - RNA, 88 nt, Mus musculus; identical to SEQ ID NO: 3074

SEQ ID NO: 3419 - RNA, 85 nt, Mus musculus
cuggcugagguaguaguuugugcuguuggucggguugugacauugcccgcuguggagauaacugcgcaagcuacugccuugcuag

SEQ ID NO: 3420 - RNA, 122 nt, Mus musculus
auuggaggcuauuucugaucaugauaauuuccugagguauuaguuugugcuguuauaugaaucgaauaauaucccuugcucagauuaaaagccuggaguuaaaaaaaucaagugccuugaac

SEQ ID NO: 3421 - RNA, 110 nt, Mus musculus
uagccacagcccuaacccuagccugagguaggagguugugugcaagcucaccacuaaccuauaguacacagagagccuuuaucccacaacacaacacaaaacaauacuuc

SEQ ID NO: 3422 - RNA, 77 nt, Mus musculus
gcuugggacacauacuucuuuauaugcccauaugaaccugcuaagcuauggaauguaaagaaguauguauuucaggc

SEQ ID NO: 3423 - RNA, 72 nt, Mus musculus
ucagagcacauacuucuuuauguacccauaugaacauucagugcuauggaauguaaagaaguauguauuuug

SEQ ID NO: 3424 - RNA, 122 nt, Mus musculus
uuccuuuagcuucuucuuggcggacauuaccuacccaaaauacauacuucuuuacauuccauagcacugaauguucauauggguacauaaagaaguaugugcucugaguaggcacuccugcg

SEQ ID NO: 3425 - RNA, 108 nt, Mus musculus
uuggauguuggccuaguucuguguggaagacuagugauuuuguuguuuuuagauaacuaaaacgacaacaaaucacagucugccauauggcacaggccaccucuacag

SEQ ID NO: 3426 - RNA, 97 nt, Mus musculus
ggucgggccagccccguuuggaagacuagugauuuuguuguugugucucuguauccaacaacaagucccagucugccacauggugcuggucauuuca

SEQ ID NO: 3427 - RNA, 111 nt, Mus musculus
aggagcggaguacgugagccagugcuauguggaagacuugugauuuuguuguucugauaugauaugacaacaagucacagccagccucauagcguggacuccuaucaccuu

SEQ ID NO: 3428 - RNA, 89 nt, Mus musculus; identical to SEQ ID NO: 280

SEQ ID NO: 3429 - RNA, 72 nt, Mus musculus
guuguuaucuuugguuaucuagcuguaugaguguauuggucuucauaaagcuagauaaccgaaaguaaaaac

SEQ ID NO: 3430 - RNA, 90 nt, Mus musculus
ggaggcccguuucucucuuugguuaucuagcuguaugagugccacagagccgucauaaagcuagauaaccgaaaguagaaaugacucuca

SEQ ID NO: 3431 - RNA, 110 nt, Mus musculus
gaccugucugucuucuguauauacccuguagauccgaauuuguguaaggaauuuuguggucacaaauucguaucuaggggaauauguaguugacauaaacacuccgcuca

SEQ ID NO: 3432 - RNA, 68 nt, Mus musculus
uauauacccuguagaaccgaauuugugugguacccacauagucacagauucgauucuaggggaauaua

SEQ ID NO: 3433 - RNA, 84 nt, Mus musculus
cccuuggaguaaaguagcagcacauaaugguuuguggauguugaaaaggugcaggccauacugugcugccucaaaauacaagga

SEQ ID NO: 3434 - RNA, 64 nt, Mus musculus; identical to SEQ ID NO: 3085

SEQ ID NO: 3435 - RNA, 93 nt, Mus musculus
augucagcggugccuuagcagcacguaaauauuggcguuaagauucugaaauuaccuccaguauugacugugcugcugaaguaagguuggcaa

SEQ ID NO: 3436 - RNA, 95 nt, Mus musculus
caugcuuguuccacucuagcagcacguaaauauuggcguagugaaauaaauauuaaacaccaauauuauugugcugcuuuagugugacagggaua

SEQ ID NO: 3437 - RNA, 84 nt, Mus musculus
gucagaauaaugucaaagugcuuacagugcagguagugaugugugcaucuacugcagugagggcacuuguagcauuaugcugac

SEQ ID NO: 3438 - RNA, 96 nt, Mus musculus
ugcgugcuuuuuguucuaaggugcaucuagugcagauagugaaguagacuagcaucuacugcccuaagugcuccuucuggcauaagaaguuauguc

SEQ ID NO: 3439 - RNA, 83 nt, Mus musculus
ucucuuguguuaaggugcaucuagugcuguuagugaagcagcuuacaaucuacugcccuaaaugccccuucucgcacaggcua

SEQ ID NO: 3440 - RNA, 82 nt, Mus musculus
gcagcccucuguuaguuuugcauaguugcacuacaagaagaauguaguugugcaaaucuaugcaaaacugaugguggccugc

SEQ ID NO: 3441 - RNA, 87 nt, Mus musculus
cacuggucuaugguuaguuuugcagguuugcauccagcuguauaauauucugcugugcaaauccaugcaaaacugacugugguggug

SEQ ID NO: 3442 - RNA, 84 nt, Mus musculus
acuuacgauuaguuuugcagauuugcaguucagcguauaugugaauauauggcugugcaaauccaugcaaaacugauuguggga

SEQ ID NO: 3443 - RNA, 107 nt, Mus musculus
gugugaugugacagcuucuguagcacuaaagugcuuauagugcagguaguguguagccaucuacugcauuacgagcacuuaaaguacugccagcuguagaacuccag

SEQ ID NO: 3444 - RNA, 80 nt, Mus musculus
ccuaguagugccaaagugcucauagugcagguaguuuuuauaccacucuacugcagugugagcacuucuaguacuccugg

SEQ ID NO: 3445 - RNA, 92 nt, Mus musculus
uguaccaccuugucggauagcuuaucagacugauguugacuguugaaucucauggcaacagcagucgaugggcugucugacauuuugguauc

SEQ ID NO: 3446 - RNA, 108 nt, Mus musculus
uuugaggauacucuugcauauggauaguuuaucagacugauauuuccauaagacaaguaugagaaaauccuucuguacuaucuuucuggcuuuuguguaucuuacaau

SEQ ID NO: 3447 - RNA, 78 nt, Mus musculus
aagucuucuuuguagcuuagcuuaucagacugguacaaucuucuugacagcucuguucagcuauucucagggggacuc

SEQ ID NO: 3448 - RNA, 95 nt, Mus musculus
accuggcugagccgcaguaguucuucaguggcaagcuuuauguccugacccagcuaaagcugccaguugaagaacuguugcccucugccccuggc

SEQ ID NO: 3449 - RNA, 75 nt, Mus musculus
cggacggcugggguuccuggggaugggauuugaugccagucacaaaucacauugccagggauuuccaacugaccc

SEQ ID NO: 3450 - RNA, 74 nt, Mus musculus
ggcugcuuggguuccuggcaugcugauuugugacuugagauuaaaaucacauugccagggauuaccacgcaacc

SEQ ID NO: 3451 - RNA, 68 nt, Mus musculus
cuccggugccuacugagcugauaucaguucucauuucacacacuggcucaguucagcaggaacaggag

SEQ ID NO: 3452 - RNA, 107 nt, Mus musculus
gccucucuccgggcuccgccucccgugccuacugagcugaaacaguugauuccagugcacuggcucaguucagcaggaacaggaguccagcccccuaggagcuggca

SEQ ID NO: 3453 - RNA, 84 nt, Mus musculus; identical to SEQ ID NO: 154

SEQ ID NO: 3454 - RNA, 90 nt, Mus musculus
aaggccguggccucguucaaguaauccaggauaggcugugcaggucccaaggggccuauucuugguuacuugcacggggacgcgggccug

SEQ ID NO: 3455 - RNA, 84 nt, Mus musculus
ggcugcggcuggauucaaguaauccaggauaggcuguguccguccaugaggccuguucuugauuacuuguuucuggaggcagcg

SEQ ID NO: 3456 - RNA, 85 nt, Mus musculus
ugcccgggacccaguucaaguaauucaggauagguuguggugcugaccagccuguucuccauuacuuggcucgggggccggugcc

SEQ ID NO: 3457 - RNA, 87 nt, Mus musculus
uggccugaggagcagggcuuagcugcuugugagcaagguccacagcaaagucguguucacaguggcuaaguuccgcccccuggaccc

SEQ ID NO: 3458 - RNA, 73 nt, Mus musculus
aggugcagagcuuagcugauuggugaacagugauugguuuccgcuuuguucacaguggcuaaguucugcaccu

SEQ ID NO: 3459 - RNA, 86 nt, Mus musculus
ggucccuaccuucaaggagcucacagucuauugaguugccuuucugauucucccacuagauugugagcugcuggagggcaggcacu

SEQ ID NO: 3460 - RNA, 80 nt, Mus musculus
gacuauagaaaaggagcucacaaucuauuuaguggcaggcgcacacugccagaaugugugaggcaucuuaauagugugcu

SEQ ID NO: 3461 - RNA, 75 nt, Mus musculus
ucacugcaguuacaaagacaaaugagauaugaucccuacccuugaggagcucacagucuauugaacacaagcagc

SEQ ID NO: 3462 - RNA, 88 nt, Mus musculus
accccuuagaggaugacugauuucuuuugguguucagagucaauagaauuuucuagcaccaucugaaaucgguuauaaugauugggga

SEQ ID NO: 3463 - RNA, 71 nt, Mus musculus
aggaagcugguuucauauggugguuuagauuuaaauagugauugucuagcaccauuugaaaucaguguucu

SEQ ID NO: 3464 - RNA, 81 nt, Mus musculus; identical to SEQ ID NO: 167

SEQ ID NO: 3465 - RNA, 88 nt, Mus musculus; identical to SEQ ID NO: 168

SEQ ID NO: 3466 - RNA, 71 nt, Mus musculus
gcgacuguaaacauccucgacuggaagcugugaagccacaaaugggcuuucagucggauguuugcagcugc

SEQ ID NO: 3467 - RNA, 96 nt, Mus musculus
cuaagccaaguuucaguucauguaaacauccuacacucagcugucauacaugcguuggcugggauguggauguuuacgucagcugucuuggaguau

SEQ ID NO: 3468 - RNA, 89 nt, Mus musculus
accauguuguaguguguguaaacauccuacacucucagcugugagcucaagguggcugggagaggguuguuuacuccuucugccaugga

SEQ ID NO: 3469 - RNA, 84 nt, Mus musculus
gagugacagauauuguaaacauccuacacucucagcugugaaaaguaagaaagcugggagaaggcuguuuacucucucugccuu

SEQ ID NO: 3470 - RNA, 82 nt, Mus musculus
aagucugugucuguaaacauccccgacuggaagcuguaagccacagccaagcuuucagucagauguuugcugcuacuggcuc

SEQ ID NO: 3471 - RNA, 92 nt, Mus musculus
gggcagucuuugcuacuguaaacauccuugacuggaagcuguaagguguugagaggagcuuucagucggauguuuacagcggcaggcugcca

SEQ ID NO: 3472 - RNA, 92 nt, Mus musculus
uggcagccugccgcuguaaacauccgacugaaagcuccucucaacaccuuacagcuuccagucaaggauguuuacaguagcaaagacugccc

SEQ ID NO: 3473 - RNA, 106 nt, Mus musculus
ugcuccuguaacucggaacuggagaggaggcaagaugcuggcauagcuguugaacugagaaccugcuaugccaacauauugccaucuuuccugucugacagcagcu

SEQ ID NO: 3474 - RNA, 70 nt, Mus musculus; identical to SEQ ID NO: 185

SEQ ID NO: 3475 - RNA, 69 nt, Mus musculus
cuguggugcauuguaguugcauugcauguucuggcaauaccugugcaauguuuccacagugcaucacgg

SEQ ID NO: 3476 - RNA, 102 nt, Mus musculus
ccagcugugaguaauucuuuggcagugucuuagcugguuguugugaguauuagcuaaggaagcaaucagcaaguauacugcccuagaagugcugcacauugu

SEQ ID NO: 3477 - RNA, 84 nt, Mus musculus
gugcucgguuuguaggcaguguaauuagcugauuguagugcggugcugacaaucacuaacuccacugccaucaaaacaaggcac

SEQ ID NO: 3478 - RNA, 77 nt, Mus musculus
agucuaguuacuaggcaguguaguuagcugauugcuaauaguaccaaucacuaaccacacagccagguaaaaagacu

SEQ ID NO: 3479 - RNA, 80 nt, Mus musculus
cuuucuacacagguugggauuugucgcaaugcuguguuucucuguaugguauugcacuugucccggccuguugaguuugg

SEQ ID NO: 3480 - RNA, 91 nt, Mus musculus
ugcccauucauccacagguggggauugguggcauuacuuguguuagauauaaaguauugcacuugucccggccugaggaagaaagaggguu

SEQ ID NO: 3481 - RNA, 83 nt, Mus musculus
ggugggcgggagggacgggacguggugcaguguuguucuuuccccugccaauauugcacucgucccggccuccggcccccucg

SEQ ID NO: 3482 - RNA, 88 nt, Mus musculus
agucaugggggcuccaaagugcuguucgugcagguaguguaauuaccugaccuacugcugagcuagcacuucccgagcccccaggaca

SEQ ID NO: 3483 - RNA, 106 nt, Mus musculus
ccaguaccaucugcuuggccgauuuuggcacuagcacauuuuugcuugugucucuccgcugugagcaaucauguguagugccaauaugggaaaagcgggcugcugc

SEQ ID NO: 3484 - RNA, 108 nt, Mus musculus
cugcacaugcuggggugagguaguaaguuguauuguugugggguagggauuuuaggccccaguaagaagauaacuauacaacuuacuacuuuccuugguguguggcau

SEQ ID NO: 3485 - RNA, 65 nt, Mus musculus
cauaaacccguagauccgaucuuguggugaaguggaccgcgcaagcucguuucuaugggucugug

SEQ ID NO: 3486 - RNA, 70 nt, Mus musculus; identical to SEQ ID NO: 291

SEQ ID NO: 3487 - RNA, 80 nt, Mus musculus
ccuguugccacaaacccguagauccgaacuugugcugauucugcacacaagcuugugucuauagguaugugucuguuagg

SEQ ID NO: 3488 - RNA, 83 nt, Mus musculus
aggcugcccuggcucaguuaucacagugcugaugcuguccauucuaaagguacaguacugugauaacugaaggauggcagcca

SEQ ID NO: 3489 - RNA, 97 nt, Mus musculus
aucugagacugaacugcccuuuuucgguuaucaugguaccgaugcuguagcucugaaagguacaguacugugauagcugaagaauggcggugccauc

SEQ ID NO: 3490 - RNA, 75 nt, Mus musculus
ugaugcccuacugcacaguccugugaugacugacugcucaacugcacaguacugugauaacugaucgccuaacug

SEQ ID NO: 3491 - RNA, 86 nt, Mus musculus
uucuuacugcccucggcuucuuuacagugcugccuuguugcauauggaucaagcagcauuguacagggcuaugaaggcauugagac

SEQ ID NO: 3492 - RNA, 86 nt, Mus musculus
gucuucgugcuuucagcuucuuuacagugcugccuuguagcauucaggucaagcagcauuguacagggcuaugaaagaaccaagaa

SEQ ID NO: 3493 - RNA, 80 nt, Mus musculus
ugcauuuuagccaagugcucagaugcuugugguggcugcuuaugcaccacgaaugcuugagcaugugcuaugguaccuac

SEQ ID NO: 3494 - RNA, 65 nt, Mus musculus
augucaaagugcuaacagugcagguagcuuuuugaguucuacugcagugccagcacuucuuacau

SEQ ID NO: 3495 - RNA, 82 nt, Mus musculus
ccugcugggacuaaagugcugacagugcagauagugguccucucugugcuaccgcacuguggguacuugcugcuccagcagg

SEQ ID NO: 3496 - RNA, 87 nt, Mus musculus
uucucugugcuuucagcuucuuuacaguguugccuuguggcauggaguucaagcagcauuguacagggcuaucaaagcacagagagc

SEQ ID NO: 3497 - RNA, 66 nt, Mus musculus
agcuguggagugugacaaugguguuuguguccaaaccaucaaacgccauuaucacacuaaauagcu

SEQ ID NO: 3498 - RNA, 85 nt, Mus musculus; identical to SEQ ID NO: 29

SEQ ID NO: 3499 - RNA, 109 nt, Mus musculus
aucaagaucagagacucugcucuccguguucacagcggaccuugauuuaaugucauacaauuaaggcacgcggugaaugccaagagcggagccuacggcugcacuugaa

SEQ ID NO: 3500 - RNA, 68 nt, Mus musculus
cucugcguguucacagcggaccuugauuuaaugucuauacaauuaaggcacgcggugaaugccaagag

SEQ ID NO: 3501 - RNA, 68 nt, Mus musculus
cugggucccugagacccuuuaaccugugaggacguccagggucacaggugagguucuugggagccugg

SEQ ID NO: 3502 - RNA, 77 nt, Mus musculus
ugcgcuccccucagucccugagacccuaacuugugauguuuaccguuuaaauccacggguuaggcucuugggagcug

SEQ ID NO: 3503 - RNA, 71 nt, Mus musculus
gccuagucccugagacccuaacuugugagguauuuuaguaacaucacaagucagguucuugggaccuaggc

SEQ ID NO: 3504 - RNA, 73 nt, Mus musculus
ugacagcacauuauuacuuuugguacgcgcugugacacuucaaacucguaccgugaguaauaaugcgcgguca

SEQ ID NO: 3505 - RNA, 58 nt, Mus musculus
auuauuacucacgguacgaguuugaagugucacagcgcguaccaaaaguaauaaugug

SEQ ID NO: 3506 - RNA, 70 nt, Mus musculus; identical to SEQ ID NO: 3150

SEQ ID NO: 3507 - RNA, 70 nt, Mus musculus; identical to SEQ ID NO: 3152

SEQ ID NO: 3508 - RNA, 76 nt, Mus musculus
cagugggaaggggggccgaugcacuguaagagagugaguagcaggucucacagugaaccggucucuuucccuacug

SEQ ID NO: 3509 - RNA, 73 nt, Mus musculus
uggaucuuuuugcggucugggcuugcuguucucucgacaguagucaggaagcccuuaccccaaaaaguaucua

SEQ ID NO: 3510 - RNA, 90 nt, Mus musculus
ugccuuucgcgaaucuuuuugcggucugggcuugcuguacauaacucaauagccggaagcccuuaccccaaaaagcauucgcggagggcg

SEQ ID NO: 3511 - RNA, 65 nt, Mus musculus
gcuuuuugggguaagggcuuccggcuauugaguuauguacagcaagcccagaccgcaaaaagauu

SEQ ID NO: 3512 - RNA, 64 nt, Mus musculus
gagcucuuuucacauugugcuacugucuaacguguaccgagcagugcaauguuaaaagggcauc

SEQ ID NO: 3513 - RNA, 82 nt, Mus musculus
ggcuuguuggacacucuuucccuguugcacuacugugggccucugggaagcagugcaaugaugaaagggcaucugucgggcc

SEQ ID NO: 3514 - RNA, 82 nt, Mus musculus
guuacgguuuggauguaaaauguccccugcagguuugugugucaaagacucuguguccagugcaauguuccaaggugugacu

SEQ ID NO: 3515 - RNA, 66 nt, Mus musculus
gggcaaccguggcuuucgauuguuacugugggaaccggagguaacagucuacagccauggucgccc

SEQ ID NO: 3516 - RNA, 68 nt, Mus musculus
gcuaaagcugguaaaauggaaccaaaucgccucuucaauggauuugguccccuucaaccagcuguagc

SEQ ID NO: 3517 - RNA, 104 nt, Mus musculus
agaagccaaaugcuuugcugaagcugguaaaauggaaccaaaucagcuguuggauggauuugguccccuucaaccagcuguagcugcgcauugaucacgccgca

SEQ ID NO: 3518 - RNA, 119 nt, Mus musculus
ccuccaaagggaguggcccccugcucuggcuggucaaacggaaccaaguccgucuuccugagagguuugguccccuucaaccagcuacagcagggcuggcaaagcucaauauuuggaga

SEQ ID NO: 3519 - RNA, 80 nt, Mus musculus
aggcucaugaagacaccaaaggagacauccccagcagucggcuggcugguuucaguuugguccccuucaaggagucaggg

SEQ ID NO: 3520 - RNA, 71 nt, Mus musculus
agggugugugacugguugaccagaggggcgugcacucuguucacccugugggccaccuagucaccaacccu

SEQ ID NO: 3521 - RNA, 90 nt, Mus musculus
aggccucacuguucucuauggcuuuuuauuccuaugugauucuauugcucgcucauauagggauuggagccguggcguacggugaggaua

SEQ ID NO: 3522 - RNA, 100 nt, Mus musculus
agauaaauucacucuagugcuuuauggcuuuuuauuccuaugugaucguaauaaagucucauguagggauggaagccaugaaauacauugugaaaauuca

SEQ ID NO: 3523 - RNA, 97 nt, Mus musculus
cgcucugcuguggccuauggcuuuucauuccuaugugauugcugcuccgaacucauguagggcuaaaagccaugggcuacagugaggggcaagcucc

SEQ ID NO: 3524 - RNA, 62 nt, Mus musculus
gaggacuccauuuguuuugaugauggauucuuaagcuccaucaucgucucaaaugagucuuc

SEQ ID NO: 3525 - RNA, 73 nt, Mus musculus; identical to SEQ ID NO: 3166

SEQ ID NO: 3526 - RNA, 99 nt, Mus musculus
cucuagcaugguguugugggacagcugguguugugaaucaggccguugccaaucagagaacggcuacuucacaacaccagggccacacugcacugcaag

SEQ ID NO: 3527 - RNA, 71 nt, Mus musculus
cagcugguguugugaaucaggccgacgagcagcgcauccucuuacccggcuauuucacgacaccaggguug

SEQ ID NO: 3528 - RNA, 68 nt, Mus musculus; identical to SEQ ID NO: 55

SEQ ID NO: 3529 - RNA, 70 nt, Mus musculus
ccugccagugguuuuacccuaugguagguuacgucaugcuguucuaccacaggguagaaccacggacagg

SEQ ID NO: 3530 - RNA, 72 nt, Mus musculus
ggguccaucuuccagugcaguguuggaugguugaaguaugaagcuccuaacacugucugguaaagauggccc

SEQ ID NO: 3531 - RNA, 64 nt, Mus musculus; identical to SEQ ID NO: 3172

SEQ ID NO: 3532 - RNA, 115 nt, Mus musculus
gcguggucuccgaagcccacagugcacucauccauaaaguaggaaacacuacacccuccagugcuguuaguagugcuuucuacuuuaugggugacugcacugucugucuguccac

SEQ ID NO: 3533 - RNA, 63 nt, Mus musculus
ccugaggugcagugcugcaucucuggucaguugggagucugagaugaagcacuguagcucagg

SEQ ID NO: 3534 - RNA, 66 nt, Mus musculus
ggcugggauaucaucauauacuguaaguuugugaugagacacuacaguauagaugauguacuaguc

SEQ ID NO: 3535 - RNA, 70 nt, Mus musculus
cucacgguccaguuuucccaggaaucccuuggaugcuaagauggggauuccuggaaauacuguucuugag

SEQ ID NO: 3536 - RNA, 75 nt, Mus musculus
cucccuguugaagucaguccaguuuucccaggagacuccagucuggcuugagaaauugguguuaaaaacagggaa

SEQ ID NO: 3537 - RNA, 65 nt, Mus musculus
agcucugagaacugaauuccauggguuauaucaaugucagaccugugaaauucaguucuucagcu

SEQ ID NO: 3538 - RNA, 109 nt, Mus musculus
gacugagagaacuuuggccaccuggcucugagaacugaauuccauaggcugugagcucuagcagacgcccuagggacucaguucuggugcccggcugugcuauaccauc

SEQ ID NO: 3539 - RNA, 79 nt, Mus musculus
uaugaaucuaguggaaacauuucugcacaaacuagauguugaugccagugugcggaaaugcuucugcuacauuuguagg

SEQ ID NO: 3540 - RNA, 99 nt, Mus musculus
agccaguuuggucuuuugagacaaaguucugagacacuccgacucugaguaugauagaagucagugcacuacagaacuuugucucuagaggcugugguc

SEQ ID NO: 3541 - RNA, 97 nt, Mus musculus
caggcacccuuagcauuugaggugaaguucuguuauacacucaggcuguggcucugaaagucagugcaucacagaacuuugucucgaaagcuuucua

SEQ ID NO: 3542 - RNA, 66 nt, Mus musculus
ggcucuggcuccgugucuucacucccguguuuguccgaggagggagggagggacgggggcggugcu

SEQ ID NO: 3543 - RNA, 65 nt, Mus musculus
cccugucucccaacccuuguaccagugcugugccucagacccugguacaggccugggggauaggg

SEQ ID NO: 3544 - RNA, 68 nt, Mus musculus
ccugcccucgaggagcucacagucuaguaugucuccucccuacuagacugaggcuccuugaggacagg

SEQ ID NO: 3545 - RNA, 73 nt, Mus musculus
ccgggccuagguucugugauacacuccgacucgggcucuggagcagucagugcaugacagaacuugggcccgg

SEQ ID NO: 3546 - RNA, 69 nt, Mus musculus
cggugucauuuuugugacguugcagcuaguaauaugagcccaguugcauagucacaaaagugaucauug

SEQ ID NO: 3547 - RNA, 66 nt, Mus musculus
gaagauagguuauccguguugccuucgcuuuauucgugacgaaucauacacgguugaccuauuuuu

SEQ ID NO: 3548 - RNA, 65 nt, Mus musculus
cuguuaaugcuaauugugauagggguuuuggccucugacugacuccuaccuguuagcauuaacag

SEQ ID NO: 3549 - RNA, 87 nt, Mus musculus
gguugcuucagugaacauucaacgcugucggugaguuuggaauucaaauaaaaaccaucgaccguugauuguacccuauagcuaacc

SEQ ID NO: 3550 - RNA, 76 nt, Mus musculus
ccauggaacauucaacgcugucggugaguuugggauucaaaaacaaaaaaaccaccgaccguugacuguaccuugg

SEQ ID NO: 3551 - RNA, 80 nt, Mus musculus
aggucacaaucaacauucauugcugucgguggguugaacuguguagaaaagcucacugaacaaugaaugcaacuguggcc

SEQ ID NO: 3552 - RNA, 89 nt, Mus musculus
uugauggcugcacucaacauucauugcugucgguggguuugaaugucaaccaacucacugaucaaugaaugcaaacugcgggccaaaaa

SEQ ID NO: 3553 - RNA, 89 nt, Mus musculus
gccaaggguuugggggaacauucaaccugucggugaguuugggcagcucagacaaaccaucgaccguugaguggaccccgaggccugga

SEQ ID NO: 3554 - RNA, 72 nt, Mus musculus
acaauuaacauucauuguugucgguggguugugaggaggcagccagacccaccgggggaugaaugucacugu

SEQ ID NO: 3555 - RNA, 75 nt, Mus musculus
accauuuuuggcaaugguagaacucacaccgguaagguaaugggacccggugguucuagacuugccaacuauggu

SEQ ID NO: 3556 - RNA, 70 nt, Mus musculus
cuguguauggcacugguagaauucacugugaacagucucagucagugaauuaccgaagggccauaaacag

SEQ ID NO: 3557 - RNA, 69 nt, Mus musculus
ccuuuccuuaucacuuuuccagccagcuuugugacucuaaguguuggacggagaacugauaaggguagg

SEQ ID NO: 3558 - RNA, 65 nt, Mus musculus
agggauuggagagaaaggcaguuccugaugguccccucccaggggcuggcuuuccucugguccuu

SEQ ID NO: 3559 - RNA, 71 nt, Mus musculus
acuuuccaaagaauucuccuuuugggcuuucucauuuuauuuuaagcccuaaggugaauuuuuugggaagu

SEQ ID NO: 3560 - RNA, 61 nt, Mus musculus
ucaggcuacaacacaggacccgggcgcugcucugaccccucgugucuuguguugcagccgg

SEQ ID NO: 3561 - RNA, 68 nt, Mus musculus
ucucacaucccuugcaugguggagggugagcucucugaaaaccccucccacaugcaggguuugcagga

SEQ ID NO: 3562 - RNA, 67 nt, Mus musculus
cugugugauauguuugauauauuagguuguuauuuaauccaacuauauaucaagcauauuccuacag

SEQ ID NO: 3563 - RNA, 80 nt, Mus musculus
ugcuucugugugauauguuugauauuggguuguuaaauuaugaaccaacugaaugucaagcauacucucacagcaguaag

SEQ ID NO: 3564 - RNA, 74 nt, Mus musculus
agcgggcaacggaaucccaaaagcagcuguugucuccagagcauuccagcugcacuuggauuucguucccugcu

SEQ ID NO: 3565 - RNA, 89 nt, Mus musculus
cgugcacagggcucugaccuaugaauugacagccaguacucuuuucucuccucuggcugccaauuccauaggucacagguauguucacc

SEQ ID NO: 3566 - RNA, 66 nt, Mus musculus
gagagcugggucuuugcgggcaagaugagagugucaguucaacuggccuacaaagucccaguccuc

SEQ ID NO: 3567 - RNA, 79 nt, Mus musculus
ggcccagaaucgggguuuugagggcgagaugaguuuguguuuuauccaacuggcccacaaagucccgcuuuugggguca

SEQ ID NO: 3568 - RNA, 67 nt, Mus musculus
aucggguguaacagcaacuccauguggacugugcucggauuccaguggagcugcuguuacuucugau

SEQ ID NO: 3569 - RNA, 86 nt, Mus musculus
guggcucccacccucuguaacagcaacuccauguggaagugcccacugguuccaguggggcugcuguuaucugggguggcggcuag

SEQ ID NO: 3570 - RNA, 94 nt, Mus musculus
acacccaacucuccuggcucuagcagcacagaaauauuggcauggggaagugagucugccaauauuggcugugcugcuccaggcagggugguga

SEQ ID NO: 3571 - RNA, 97 nt, Mus musculus
agaaaggacuuaaauagcagcacagaaauaguagaaaacacagcccaacagcuuuggcuugaauuacugcucuccuguaacugauauagucuuuuuc

SEQ ID NO: 3572 - RNA, 102 nt, Mus musculus
ugagccgggacuguugagugaaguagguaguuucauguuguugggccuggcuuucugaacacaacgacaucaaaccaccugauucauggcaguuacugcuuc

SEQ ID NO: 3573 - RNA, 85 nt, Mus musculus
agcugaucuguggcuuagguaguuucauguuguugggauugaguuuugaacucggcaacaagaaacugccugaguuacaucaguc

SEQ ID NO: 3574 - RNA, 85 nt, Mus musculus
aacuggucggugauuuagguaguuuccuguuguugggauccaccuuucucucgacagcacgacacugccuucauuacuucaguug

SEQ ID NO: 3575 - RNA, 70 nt, Mus musculus
gccaucccaguguucagacuaccuguucaggaggcugggacauguacaguagucugcacauugguuaggc

SEQ ID NO: 3576 - RNA, 110 nt, Mus musculus
uggaagcuucaggagauccugcuccgucgccccaguguucagacuaccuguucaggacaaugccguuguacaguagucugcacauugguuagacugggcaagggccagca

SEQ ID NO: 3577 - RNA, 110 nt, Mus musculus
ccagaggauaccuccacuccgucuacccaguguuuagacuaccuguucaggacucccaaauuguacaguagucugcacauugguuaggcugggcuggguuagacccucgg

SEQ ID NO: 3578 - RNA, 90 nt, Mus musculus; identical to SEQ ID NO: 2897

SEQ ID NO: 3579 - RNA, 70 nt, Mus musculus
gccguggccaucuuacugggcagcauuggauagugucugaucucuaauacugccugguaaugaugacggc

SEQ ID NO: 3580 - RNA, 69 nt, Mus musculus
cccucgucuuacccagcaguguuugggugcugguugggagucucuaauacugccggguaaugauggagg

SEQ ID NO: 3581 - RNA, 66 nt, Mus musculus
uaccuuacucaguaaggcauuguucuucuauauuaauaaaugaacagugccuuucuguguagggua

SEQ ID NO: 3582 - RNA, 72 nt, Mus musculus
guuccuuuuuccuaugcauauacuucuuuguggaucuggucuaaagagguauagcgcaugggaagauggagc

SEQ ID NO: 3583 - RNA, 76 nt, Mus musculus
gccugguccagugguucuugacaguucaacaguucuguagcacaauugugaaauguuuaggaccacuagacccggc

SEQ ID NO: 3584 - RNA, 68 nt, Mus musculus; identical to SEQ ID NO: 3214

SEQ ID NO: 3585 - RNA, 68 nt, Mus musculus
cucuuguccuucauuccaccggagucugucuuaugccaaccagauuucaguggagugaagcucaggag

SEQ ID NO: 3586 - RNA, 73 nt, Mus musculus
ccaggccacaugcuucuuuauauccucauagauaucucagcacuauggaauguaaggaagugugugguuuugg

SEQ ID NO: 3587 - RNA, 79 nt, Mus musculus
aaggcaggggugaggggcugcgggaggagccgggcggaggcugcggcuugcgcuucuccuggcucuccucccucucuuu

SEQ ID NO: 3588 - RNA, 83 nt, Mus musculus
uuccuuugacgggugagcuuuuggcccggguuauaccugacacucacguauaagacgagcaaaaagcuuguuggucagaggag

SEQ ID NO: 3589 - RNA, 77 nt, Mus musculus
ccucucagggaagcuuuuugcucgcguuauguuucucauccgaauauaagacgaacaaaagguuugucugagggcug

SEQ ID NO: 3590 - RNA, 110 nt, Mus musculus
ccggggcagucccuccaggcucaggacagccacugcccaccgcacacugcguugcuccggacccacugugcgugugacagcggcugaucugucccugggcagcgcgaacc

SEQ ID NO: 3591 - RNA, 106 nt, Mus musculus
cugcuuggaccugugaccugugggcuucccuuugucauccuuugccuaggccucugagugaggcaaggacagcaaaggggggcucaguggucaccucuacugcaga

SEQ ID NO: 3592 - RNA, 91 nt, Mus musculus
gggcagcgcgccggcaccuuggcucuagacugcuuacugcccgggccgccuucaguaacagucuccagucacggccaccgacgccuggccc

SEQ ID NO: 3593 - RNA, 110 nt, Mus musculus; identical to SEQ ID NO: 134

SEQ ID NO: 3594 - RNA, 112 nt, Mus musculus
agcucucagcaucaacgguguacaggagaaugaccuaugauuugacagaccgugcagcuguguaugucugucauucuguaggccaauauucuguaugucacugcuacuuaaa

SEQ ID NO: 3595 - RNA, 72 nt, Mus musculus
uugguuuaaucucagcuggcaacugugagaugucccuaucauuccucacaguggucucugggauuaugcuaa

SEQ ID NO: 3596 - RNA, 86 nt, Mus musculus
uuggcagacugggaaaucucugcaggcaaaugugaugucacugaagaaaccacacacuuaccuguagagauucuucagucugacaa

SEQ ID NO: 3597 - RNA, 69 nt, Mus musculus
gaagaaucucuacagguaagugugugguuucuucagugacaucacauuugccugcagagauuucccagu

SEQ ID NO: 3598 - RNA, 108 nt, Mus musculus
aaacauagucauuacaguuuuugauguugcagauacugcaucaggaacugacuggauaagacuuaauccccaucaguuccuaaugcauugccuucagcaucuaaacaa

SEQ ID NO: 3599 - RNA, 110 nt, Mus musculus
gugauaauggagcgagauuuucuguugugcuugaucuaaccaugugcuugcgagguaugagaaaaacaugguuccgucaagcaccauggaacgucacgcagcuuucuaca

SEQ ID NO: 3600 - RNA, 110 nt, Mus musculus
gaccaguugccgcggggcuuuccuuugugcuugaucuaaccaugugguggaacgauggaaacggaacaugguucugucaagcaccgcggaaagcaucgcucucuccugca

SEQ ID NO: 3601 - RNA, 110 nt, Mus musculus
ccgucccgggccgcggcuccugauuguccaaacgcaauucucgagucucuggcuccggccgagaguugcgucuggacgucccgagccgccgcccccaaaccucgaggggg

SEQ ID NO: 3602 - RNA, 97 nt, Mus musculus
acucaggggcuucgccacugauuguccaaacgcaauucuuguacgagucugcggccaaccgagaauuguggcuggacaucugugguugagcuccggg

SEQ ID NO: 3603 - RNA, 65 nt, Mus musculus
agauguccagccacaauucucgguuggccgcagacucguacaagaauugcguuuggacaaucagu

SEQ ID NO: 3604 - RNA, 60 nt, Mus musculus
ggacguccagacgcaacucucggccggagccagagacucgagaauugcguuuggacaauc

SEQ ID NO: 3605 - RNA, 95 nt, Mus musculus
auccaggucuggggcaugaaccuggcauacaauguagauuucuguguuuguuaggcaacagcuacauugucugcuggguuucaggcuaccuggaa

SEQ ID NO: 3606 - RNA, 79 nt, Mus musculus
cccucaguggcucaguagccaguguagauccugucuuugguaaucagcagcuacaucuggcuacugggucucugguggc

SEQ ID NO: 3607 - RNA, 110 nt, Mus musculus
ucuggccaucugcagugucacgcuccguguauuugacaagcugaguuggacacucugugugguagagugucaguuugucaaauaccccaaguguggcucaugccuaucag

SEQ ID NO: 3608 - RNA, 82 nt, Mus musculus
gggcuuuuaagucacuagugguuccguuuaguagaugguuugugcauuguuucaaaauggugcccuagugacuacaaagccc

SEQ ID NO: 3609 - RNA, 83 nt, Mus musculus
cucaucuugcgguacucaaacuaugggggcacuuuuuuuuuucuuuaaaaagugccgccuaguuuuaagccccgccgguugag

SEQ ID NO: 3610 - RNA, 58 nt, Mus musculus
gcuuaaaacuaggcggcacuuuuuaaagaaaaaaaaaagugcccccauaguuugagua

SEQ ID NO: 3611 - RNA, 82 nt, Mus musculus
ccuauguagcggccaucaaaguggaggcccucucuugagccugaaugagaaagugcuuccacuuugugugccacugcauggg

SEQ ID NO: 3612 - RNA, 79 nt, Mus musculus
acauacagugucgaucaaaguggaggcccucuccgcggcuuggcgggaaagugcauccauuuuguuugucucugugugu

SEQ ID NO: 3613 - RNA, 82 nt, Mus musculus
cagccugugauacucaaacugggggcucuuuuggauuuucaucggaagaaaagugccgccagguuuugagugucaccgguug

SEQ ID NO: 3614 - RNA, 62 nt, Mus musculus
acucaaaaccuggcggcacuuuucuuccgaugaaaauccaaaagagcccccaguuugaguau

SEQ ID NO: 3615 - RNA, 80 nt, Mus musculus
uucaaucugugguacucaaacugugugacauuuuguucuuuguaagaagugccgcagaguuuguaguguugccgauugag

SEQ ID NO: 3616 - RNA, 84 nt, Mus musculus
uuccauauagccauacucaaaauggaggcccuaucuaagcuuuuaaguggaaagugcuucccuuuuguguguugccauguggag

SEQ ID NO: 3617 - RNA, 69 nt, Mus musculus
ggugagacucaaauguggggcacacuucuggacuguacauagaaagugcuacuacuuuugagucucucc

SEQ ID NO: 3618 - RNA, 79 nt, Mus musculus
gggccuuucuggagggcccccccucaauccuguugugcucgcuucagaggguuggguggaggcucuccugaaggugucc

SEQ ID NO: 3619 - RNA, 76 nt, Mus musculus
auauguauguauguauguaugugugcaugugcaugugcauguaugcauauugcauguauauauuaugcauacaugu

SEQ ID NO: 3620 - RNA, 90 nt, Mus musculus
cuguguguauauguaugugugcaugugcauguguguauaugaguauacauauacauacgcacauacccauacaagcaugcacacaaaccc

SEQ ID NO: 3621 - RNA, 102 nt, Mus musculus
cuguguguauauguaugugugcaugugcauguguguauaugaauauacauauacauacacacauacccauacaaacaugcacacaaacacacagaaaauuga

SEQ ID NO: 3622 - RNA, 98 nt, Mus musculus
cuguguguauauguaugugugcaugugcauguguguauaugaguauacauauacauacacacauacccauacaagcaugcacacaaauacacgcaaaa

SEQ ID NO: 3623 - RNA, 109 nt, Mus musculus
ucuauuugcuuguguguauauguaugugugcaugaacauguguauaugaauauacauauacauacacacauacccauacaaacaugcauacaaacacacagaaaaugga

SEQ ID NO: 3624 - RNA, 98 nt, Mus musculus
cuguguguauauguaugugugcauguacauguguguauaugaauauacauauacauacacacauacccauacaaacaugcauacaaacacacaaaaau

SEQ ID NO: 3625 - RNA, 82 nt, Mus musculus
ccaggccuuuggcagaggagggcuguucuucccuugaguuuuaugacugggaggaacuagccuucucucagcuuaggagugg

SEQ ID NO: 3626 - RNA, 63 nt, Mus musculus; identical to SEQ ID NO: 2924

SEQ ID NO: 3627 - RNA, 49 nt, Mus musculus
gguuuaccgucccacauacauacucaaaauguaugugggacgguaaacc

SEQ ID NO: 3628 - RNA, 79 nt, Mus musculus
gcuacuugaagagagguuauccuuuguguguuugcuuuacgcgaaaugaauaugcaagggcaagcucucuucgaggagc

SEQ ID NO: 3629 - RNA, 86 nt, Mus musculus
ccugcuaacggcugcucugacuuuauugcacuacuguacuuuacagcgagcagugcaauaguauugucaaagcauccgcgagcagg

SEQ ID NO: 3630 - RNA, 97 nt, Mus musculus
uuuccugcuggcugcgggugcucugacuagguugcacuacugugcugugagaagcagugcaaugguauugucaaagcaucugggaccagccucgaag

SEQ ID NO: 3631 - RNA, 69 nt, Mus musculus
ccaccacuuaaacgugguuguacuugcuuuagaccuaagaaaguaagugcuuccauguuuuggugaugg

SEQ ID NO: 3632 - RNA, 74 nt, Mus musculus
guucccuucaacuuuaacaugggaaugcuuucugucucaucgaagaguaagugcuuccauguuuuaguagaagu

SEQ ID NO: 3633 - RNA, 68 nt, Mus musculus
ccucugcuuuaacaugggguuaccugcuguguuaaacaaaagcaagugcuuccauguuucaguggggg

SEQ ID NO: 3634 - RNA, 66 nt, Mus musculus
ccuuuacuuuaacauggaggcacuugcugugcauuuaaaaauaagugcuuccauguuugagugugg

SEQ ID NO: 3635 - RNA, 82 nt, Mus musculus
gccucgccgcccuccgccuucucuucccgguucuucccggagucgggaaaagcuggguugagagggcgaaaaaggauguggg

SEQ ID NO: 3636 - RNA, 95 nt, Mus musculus
ccucguugacuccgaagggcugcagcagcaauucauguuuuggaguauugccaagguucaaaacaugaagcgcugcaacaccccuucguggggaa

SEQ ID NO: 3637 - RNA, 86 nt, Mus musculus
uugguacuuggagagaggugguccguggcgcguucgcuucauuuauggcgcacauuacacggucgaccucuuugcgguaucuaauc

SEQ ID NO: 3638 - RNA, 89 nt, Mus musculus
aacugacuaugccuccucgcauccccuagggcauugguguaaagcuggagacccacugccccaggugcugcuggggguuguagucugac

SEQ ID NO: 3639 - RNA, 98 nt, Mus musculus
auauagugcuugguuccuaguaggugcucaguaaguguuugugacauaauucguuuauugagcaccuccuaucaaucaagcacugugcuaggcucugg

SEQ ID NO: 3640 - RNA, 95 nt, Mus musculus
cucaucugucuguugggcugggggcagggccuuugugaaggcggguuaugcucagaucgccucugggcccuuccuccagucccgaggcagauuua

SEQ ID NO: 3641 - RNA, 69 nt, Mus musculus
ugcccuuauaacuugaggggcaugaggauagucaguaguccaacaucccucuugauggcacauugcaca

SEQ ID NO: 3642 - RNA, 97 nt, Mus musculus
cugucucggagccuggggcaggggggcaggaggggcucagggagaaaguaucuacagccccuggcccucucugcccuuccguccccuguccccaagu

SEQ ID NO: 3643 - RNA, 97 nt, Mus musculus
uguucgcuucugguaccggaagagagguuuucugggucucuguuucuuugaugagaaugaaacacacccagcuaaccuuuuuuucaguaucaaaucc

SEQ ID NO: 3644 - RNA, 98 nt, Mus musculus
gacccuuuggcgaucucugccucucugggccugugucuuaggcucuucaagauccaacgagcaaagcacagggccugcagagagguagcgcucugcuc

SEQ ID NO: 3645 - RNA, 96 nt, Mus musculus
gagucugguuuuguuuggguuuguucuagguauggucccagggaucccagaucaaaccaggccccugggccuauccuagaaccaaccuaaacccgu

SEQ ID NO: 3646 - RNA, 98 nt, Mus musculus
ucuuuugggcgggggucaagagcaauaacgaaaaauguuuguuuuucguaaaccguuuuucauuauugcuccugacccccucucauggguuauagcca

SEQ ID NO: 3647 - RNA, 97 nt, Mus musculus
caguguagugagaaguuggggggugggaacggcgucaugcaggaguugauugcacagccauucagcuccuauaugaugccuuucuucacccccuuca

SEQ ID NO: 3648 - RNA, 98 nt, Mus musculus
caacgcugcacaggccguccuccccaacaauauccuggugcugagugggugcacagugacuccagcaucagugauuuuguugaagagggcagcugcca

SEQ ID NO: 3649 - RNA, 96 nt, Mus musculus
acgggguggccacuaucccuguccuccaggagcucacguaugccugccugugagcgccucggcgacagagccgguguccaccccugcacuguccac

SEQ ID NO: 3650 - RNA, 98 nt, Mus musculus
caauuguacuuggugugauuauaaagcaaugagacugauugucauaugucguuugugggauccgucucaguuacuuuauagccauaccugguaucuua

SEQ ID NO: 3651 - RNA, 96 nt, Mus musculus
aaaaugaugaugucaguuggccggucggccgaucgcucggucugucagucagucggucggucgaucggucggucggucagucggcuuccugucuuc

SEQ ID NO: 3652 - RNA, 99 nt, Mus musculus
gaaaaugggcucaaggugaggggugcuaucugugauugagggacauggucaauggaauugucucacacagaaaucgcacccgucaccuuggccugcuga

SEQ ID NO: 3653 - RNA, 75 nt, Mus musculus
ugggauagaguggguguggcggggguagcagagcccagggcaaccucucccuucaugugcccagauccugcaugc

SEQ ID NO: 3654 - RNA, 95 nt, Mus musculus
cugcagccaggguuuuuaccagucaggcuccuggcuagauuccagguaccagcugguaccugaucuagccaaagccugacuguaagcccugaaca

SEQ ID NO: 3655 - RNA, 80 nt, Mus musculus
uuuuuaccagucaggcuccuggcuagauuccagguaccaacugguaccugaucuagccaaagccugacuguaagcugcaa

SEQ ID NO: 3656 - RNA, 63 nt, Mus musculus
aucagucaggcuccuggcuaaaguucagcuuucagcugcauuuagccaaagccugacuguaag

SEQ ID NO: 3657 - RNA, 92 nt, Mus musculus
cugcaaggguuuuuuucagucaggcugcuggcuagaguacagcuaucagcugguaccugaucuagucaaagccugacaguaaacugcuccag

SEQ ID NO: 3658 - RNA, 69 nt, Mus musculus
aucagucaggcugcuggcuauacaccaggacuuaucugguccuggauauaaccacugccagacugaaag

SEQ ID NO: 3659 - RNA, 80 nt, Mus musculus
agauuucauuagucugguugcuggcuauauuccaggacuuaucugguccuggauauaaccacugccagacugaauggugc

SEQ ID NO: 3660 - RNA, 80 nt, Mus musculus
agauuucaucagucaggcuagugguuauacuccaggacuuaucugguccuggauauaaccacugccagacugaauggugc

SEQ ID NO: 3661 - RNA, 66 nt, Mus musculus
cagucaggcuucuggcuauauuccaggacuuaccugguccuggauauaaccaaagccugacuauau

SEQ ID NO: 3662 - RNA, 68 nt, Mus musculus
ccagucagucuccuggcuggaguccagcucuaagcugguuccaggcucuagccaggaccugacuacaa

SEQ ID NO: 3663 - RNA, 71 nt, Mus musculus
ugccagucaggcuccuggcaggaguccugcucucagcugguuccaggcucuagccaggggcuugacugcaa

SEQ ID NO: 3664 - RNA, 60 nt, Mus musculus
caggcuucuggcuauauuccaggacauaccugguccuggguauaaccaaagcccgacugu

SEQ ID NO: 3665 - RNA, 60 nt, Mus musculus; identical to SEQ ID NO: 3664

SEQ ID NO: 3666 - RNA, 88 nt, Mus musculus
gggauuuugcaagucaggcuccuggcuggaguccagcucucagcuggguccaggcucuagccagggucugacuacaugaugcucagua

SEQ ID NO: 3667 - RNA, 96 nt, Mus musculus
acccaaguccaggccugcugaccccuaguccagugcuugugguggcuacugggcccugaacuaggggucuggagaccuggguuugaucuccacagg

SEQ ID NO: 3668 - RNA, 98 nt, Mus musculus
ucuguguugggcgucugucugcccgagugccugccucucuguugcucugaaggaggcaggggcugggccugcagcugccugggcagagcugcuccuuc

SEQ ID NO: 3669 - RNA, 99 nt, Mus musculus
agaugccuugcuccuacaagaguaaagugcaugcgcuuugggacagugaggaaaauaauguucacaaagcccauacacuuucacccuuuaggagaguug

SEQ ID NO: 3670 - RNA, 99 nt, Mus musculus
cauggcaccuccguuucccugaggagcccuuugagccuggagugaaaaaaaaaaacaggucaagaggcgccugggaacuggagaagaguguuaaacuuc

SEQ ID NO: 3671 - RNA, 70 nt, Mus musculus
gaagcuuaucagaaucuccagggguacuuaguauuugaaaagucccccaggugugauucugauuuguuuc

SEQ ID NO: 3672 - RNA, 65 nt, Mus musculus
cucgaauccuuggaaccuaggugugaaugcugcuucagugcaacacaccuguucaaggauucaaa

SEQ ID NO: 3673 - RNA, 75 nt, Mus musculus
uguuaucagguggaacacgaugcaauuuugguugguguaauaggaggaaaauugcacgguauccaucuguaaacc

SEQ ID NO: 3674 - RNA, 87 nt, Mus musculus
accgcagggaaaaugagggacuuuugggggcagauguguuuccauuccgcuaucauaaugccccuaaaaauccuuauugcucuugca

SEQ ID NO: 3675 - RNA, 112 nt, Mus musculus
agagugaucaaggacagcaagaaaaaugagggacuuucaggggcagcuguguuuccugacucagucauaaugccccuaaaaauccuuauuguucuugcagugugcaucggag

SEQ ID NO: 3676 - RNA, 75 nt, Mus musculus
aggccgucacuguugcuaacaugcaacucuguugaauagaaauuggaauugcacuuuagcaauggugauggaccu

SEQ ID NO: 3677 - RNA, 79 nt, Mus musculus
gguacuugaagggagaucgaccguguuauauucgcuuggcugacuucgaauaauacaugguugaucuuuucucaguauc

SEQ ID NO: 3678 - RNA, 79 nt, Mus musculus
agacggagagaccaggucacgucucugcaguuacacagcucaugagugccugcugggguggaaccugguuugucugucu

SEQ ID NO: 3679 - RNA, 95 nt, Mus musculus
gaagaaauccuacucggguggauauaauacaaccugcuaaguguucuagcacuuagcagguuguauuaucauuguccgagguuauggcucucguc

SEQ ID NO: 3680 - RNA, 49 nt, Mus musculus
gauaauacaaccugcuaagugcuagaacacuuagcagguuguauuauau

SEQ ID NO: 3681 - RNA, 64 nt, Mus musculus; identical to SEQ ID NO: 232

SEQ ID NO: 3682 - RNA, 68 nt, Mus musculus
uaaaagguagauucuccuucuaugaguacaauauuaaugacuaaucguagaggaaaauccacguuuuc

SEQ ID NO: 3683 - RNA, 82 nt, Mus musculus
ugguauuuaaaagguggauauuccuucuaugguuacgugcuuccuggauaaucauagaggaacauccacuuuuucaguauca

SEQ ID NO: 3684 - RNA, 86 nt, Mus musculus
uuugguauuuaaaagguggauauuccuucuauguuuaugcuuuuugugauuaaacauagaggaaauuucacguuuucagugucaaa

SEQ ID NO: 3685 - RNA, 68 nt, Mus musculus
ugagcagagguugcccuuggugaauucgcuuuauugauguugaaucacacaaaggcaacuuuuguuug

SEQ ID NO: 3686 - RNA, 66 nt, Mus musculus; identical to SEQ ID NO: 3272

SEQ ID NO: 3687 - RNA, 92 nt, Mus musculus
uguccugggcuaucccaguccaggcaguacccucaggaggcagguacgauggauagagagggaacccuggacuuggagucagaagaccugag

SEQ ID NO: 3688 - RNA, 99 nt, Mus musculus
uauacuggacuuggagucagaagccuuggguuugaggacugggcuagccucucauuaguuggguguguuaaacccaacauguagucuaucugaucugga

SEQ ID NO: 3689 - RNA, 110 nt, Mus musculus
agaugcugggauagcacuggccuuggagucagaagguuugugauuugguggcagcucugccauccaauaucccugugauuuuuagggugucaguuucccuuuaagcaccg

SEQ ID NO: 3690 - RNA, 66 nt, Mus musculus
agagaugguagacuauggaacguaggcguuauguuuuugaccuauguaacaugguccacuaacucu

SEQ ID NO: 3691 - RNA, 61 nt, Mus musculus
aagaugguugaccauagaacaugcgcuacuucugugucguauguaguaugguccacaucuu

SEQ ID NO: 3692 - RNA, 75 nt, Mus musculus; identical to SEQ ID NO: 251

SEQ ID NO: 3693 - RNA, 76 nt, Mus musculus
uacuugaagagaaguuguucgugguggauucgcuuuacuugugacgaaucauucacggacaacacuuuuuucagua

SEQ ID NO: 3694 - RNA, 70 nt, Mus musculus
cucagaucagaaggugacuguggcuuuggguggauauuaaucagccacagcacugccuggucagaaagag

SEQ ID NO: 3695 - RNA, 88 nt, Mus musculus
uguuaaaucaggaauuguaaacaauuccuaggcaauguguauaauguugguaagucauuccuagaaauuguucacaaugccuguaaca

SEQ ID NO: 3696 - RNA, 79 nt, Mus musculus
ugguacucggagagagguuacccgagcaacuuugcaucuggaggacgaauguugcucggugaaccccuuuucgguauca

SEQ ID NO: 3697 - RNA, 81 nt, Mus musculus
ggguacuugaggagagguugucugugaugaguucgcuuuauuaaugacgaauauaacacagauggccuguuuucaauacca

SEQ ID NO: 3698 - RNA, 82 nt, Mus musculus; identical to SEQ ID NO: 3281

SEQ ID NO: 3699 - RNA, 80 nt, Mus musculus
ggguaugggacggauggucgaccagcuggaaaguaauuguuucuaauguacuucaccugguccacuagccgucggugccc

SEQ ID NO: 3700 - RNA, 76 nt, Mus musculus
cauuguaggccucauuaaauguuuguugaaugaaaaaaugaaucaucaacagacauuaauugggcgccugcucugu

SEQ ID NO: 3701 - RNA, 109 nt, Mus musculus
acuugugaggaaauaaaggaaguuaggcugaggggcagagagcgagacuuuucuauuuuccaaaagcucggucugaggccccucagucuugcuuccuaccccgcgcuug

SEQ ID NO: 3702 - RNA, 85 nt, Mus musculus
aaagugcuuuggaaugacacgaucacucccguugagugggcacccaagaagccaucgggaaugucguguccgcccagugcucuuu

SEQ ID NO: 3703 - RNA, 83 nt, Mus musculus
ccugcugauggaugucuuaccagacaugguuagaucuggaugcaucugucuaauacugucugguaaugccguccauccacggc

SEQ ID NO: 3704 - RNA, 91 nt, Mus musculus
cguccugcgaggugucuugcaggccgucaugcaggccacacugacgguaacguugcaggucgucuugcagggcuucucgcaagacgacauc

SEQ ID NO: 3705 - RNA, 75 nt, Mus musculus
uggguagcucuugcauuuccuggugggggccacuggauggcuccuccacuucuuggaguagaucagugggcagcu

SEQ ID NO: 3706 - RNA, 124 nt, Mus musculus
ugcccggggagaaguacggugagccugucauuauucagagaggcuagauccucuguguugagaaggaucaugaugggcuccucgguguucuccagguagcggcaccacaccaugaaggcagccc

SEQ ID NO: 3707 - RNA, 94 nt, Mus musculus
ucgacucuggguuugaaccaaagcucgacucaugguuugaaccauuacuuaauucgugguuugaaccaucacucgacuccugguucgaaccauc

SEQ ID NO: 3708 - RNA, 112 nt, Mus musculus
acgaggagguugaacauccugcauagugcugccaggaaaucccuacuucauacuaagagggggcuggcugguugcauauguaggaugucccaucuccuggcccacuucguca

SEQ ID NO: 3709 - RNA, 91 nt, Mus musculus
cugugugugauggcuuggcaguguauuguuagcugguugaguaugugagcggcaccagcuaacaugcgacugcucuccuauugcacacaca

SEQ ID NO: 3710 - RNA, 80 nt, Mus musculus
agacucggguaggcaguguuguuagcuggcugcguugggucaggccagcagccacagcuacccugccacuuccuucuggc

SEQ ID NO: 3711 - RNA, 109 nt, Mus musculus
aggaugaagugugggugugucaggcaggcagugcauugcuagcuggcuguuagaacuuuaucccaacaguugcuagcugcacuacccucugcugcacucagaagcaugc

SEQ ID NO: 3712 - RNA, 91 nt, Mus musculus
gagagauacugagcuguuuuugcgauguguuccuaauaugugcuauaauuauauugggaacauuuugcauaaauagcuuugugucaauaca

SEQ ID NO: 3713 - RNA, 69 nt, Mus musculus
gaacuauuuuugcgauguguuccuaauauguacuaugaguauauuggggaugcuuugcauucaugguuc

SEQ ID NO: 3714 - RNA, 82 nt, Mus musculus
gauacagaauuauuuuugcaguauguuccugaauacauaacauaagcguauugggaacauuuugcaugcauaauuuuguauc

SEQ ID NO: 3715 - RNA, 72 nt, Mus musculus
cuugggaauggcgaggaaaccguuaccauuacugaguuuaguaaugguaacgguucucuugcugcucccaca

SEQ ID NO: 3716 - RNA, 72 nt, Mus musculus
ugugggagcagcaagagaaccguuaccauuacuaaacucaguaaugguaacgguuuccucgccauucccaag

SEQ ID NO: 3717 - RNA, 85 nt, Mus musculus
gcuaagcaguuacaacuguuugcagaggaaacugagacuuuauaacuaugucucagucucaucugcaaagagguaagugcuuugc

SEQ ID NO: 3718 - RNA, 82 nt, Mus musculus
agaagaugcaggagugcugugagaagugccauccccugguacuuggagggagguugccucauagugagcuugcauuauuuaa

SEQ ID NO: 3719 - RNA, 82 nt, Mus musculus
cucccuggugugagcguaugugccuuuggacuacaucgugaacgcagcaccaugcaguccacgggcauauacacuugccuca

SEQ ID NO: 3720 - RNA, 75 nt, Mus musculus
cuuuaccuaauuuguuguccaucauguaaaacauaaaugaugauagacaccauauaagguagaggaagguucacu

SEQ ID NO: 3721 - RNA, 74 nt, Mus musculus
gcccuauuuagaauggcacugaugugauaaaauaaaaaauugaucagggccuuucuaaguagaguaaggcuuac

SEQ ID NO: 3722 - RNA, 79 nt, Mus musculus
ugcaaugcccuauuuagaauggugcugaucugaugaaauaaaaaauugaucagggccuuucuaaguagaguaaggcuua

SEQ ID NO: 3723 - RNA, 79 nt, Mus musculus; identical to SEQ ID NO: 3722

SEQ ID NO: 3724 - RNA, 81 nt, Mus musculus
ugcaaugcccuauuuagaauggcgcugaucugaugaauaaaaaaaaaaugaucagggccuuucuaaguagaguaaggcuua

SEQ ID NO: 3725 - RNA, 81 nt, Mus musculus; identical to SEQ ID NO: 3724

SEQ ID NO: 3726 - RNA, 58 nt, Mus musculus
uauuuagaaugguacugaugugaugaaauaaaaaauugaucagggccuuucugaguaa

SEQ ID NO: 3727 - RNA, 73 nt, Mus musculus
uauauguguuuauguguguguacauguacauaugugaauaugauauccauauacauacacgcacacauaagac

SEQ ID NO: 3728 - RNA, 82 nt, Mus musculus
uguauguguugauguguguguacauguacaugugugaauaugauauacauauacauacacgcacacauaagacacauaugag

SEQ ID NO: 3729 - RNA, 82 nt, Mus musculus
uguauguguugauguguguguacauguacaugucugaauaugauauacauauacauacacgcacacauaagacacauaugag

SEQ ID NO: 3730 - RNA, 81 nt, Mus musculus
uauauguguugauguguguguacauguacaugugugaauaugauauacaaauacauacacgcacacauaagacacauauga

SEQ ID NO: 3731 - RNA, 90 nt, Mus musculus
uguguguauguguugauguguguguacauguacaugugugaauaugauauacauauacauacacgcacacauaagacacauaugagcaca

SEQ ID NO: 3732 - RNA, 88 nt, Mus musculus
uguguauguguugauguguguguacauguacaugugugaauaugauauacauauacauacacgcacacauaagacacauaugagcaca

SEQ ID NO: 3733 - RNA, 90 nt, Mus musculus; identical to SEQ ID NO: 3731

SEQ ID NO: 3734 - RNA, 88 nt, Mus musculus; identical to SEQ ID NO: 3732

SEQ ID NO: 3735 - RNA, 86 nt, Mus musculus
guguguauguguugauguguguguacauguacauaugugaauaugauauacauauacauacacgcacacauaagacacauaugagc

SEQ ID NO: 3736 - RNA, 84 nt, Mus musculus
guauauguguugaugugugugugcauguacauaugugaauaugauauacauauacauacacgcacacauaagacacauaugagc

SEQ ID NO: 3737 - RNA, 90 nt, Mus musculus
uguguauauguguugaugugugugugcauguacauaugugaauaugauauacauauacauacacgcacacauaagacacauaugagcaca

SEQ ID NO: 3738 - RNA, 96 nt, Mus musculus
cauguguguuugugugugcguacauguacauguguguauaugaauauacauauacauacacgcacacauagauacgcacgcacacacacacacagg

SEQ ID NO: 3739 - RNA, 84 nt, Mus musculus
guguauguguugauguguguguacauguacauaugugaauaugauauacauauacauacacgcacacauaagacacauaugagc

SEQ ID NO: 3740 - RNA, 94 nt, Mus musculus
cauguguguuuacgugugugugcaugugcauguguguauaugaauauacauacacauacacacacacauacacacacaugcaacacacacauau

SEQ ID NO: 3741 - RNA, 94 nt, Mus musculus
aauguguguuuacgugugugugcaugugcauguguguauaugaauauauguauacauacacacacacauacacacucauguaacacacacacac

SEQ ID NO: 3742 - RNA, 94 nt, Mus musculus
cauguguguuuacgugugugugcaugugcauguguguauaugaauauauguauacauacacacacacauacacacgcacgcaacacacacacac

SEQ ID NO: 3743 - RNA, 121 nt, Mus musculus
caucugcaucugugugucuacgugugugugcaugugcauguguguguaucuguaugugagugugugcaugcaugugugugcaucuauaucugugugucuacuugugugugaaugugcauau

SEQ ID NO: 3744 - RNA, 80 nt, Mus musculus
uguguuuucgugugugugcauguggauguauguauaugauuuugcauauacagacacaugcacacacaugcggcacacac

SEQ ID NO: 3745 - RNA, 81 nt, Mus musculus
uguauauuugugugugcaugugcuuguguguaugugaauauauauaucauacgcacgcacacacacacacaaaugcaagca

SEQ ID NO: 3746 - RNA, 121 nt, Mus musculus
agagaucaugucagugaacugccacauuuuugauauauauuauguauguauguguguguguguguguguguguauauauauacacacacacauacacacuacauguaugcaacauauauac

SEQ ID NO: 3747 - RNA, 122 nt, Mus musculus
gugugugugugugugcauucguguguuugugcauguguguaugugugcacauuuaugugugugcauguguauguaugugugugugcaugugcauguguguaauuguguauauaugugcauac

SEQ ID NO: 3748 - RNA, 122 nt, Mus musculus
auauauguguguguguguguguguguguacauguacaugugaguauguguguguauauguuuguacaugugcaugugugugaguaugugaauauauguguauaugugugcaugugcaugugu

SEQ ID NO: 3749 - RNA, 121 nt, Mus musculus
cuauguaugugcauguguguuuguguguacauguacauguauauauauauugauauacauauaaauacaugcacacauauucaugcaugcacacgcacacauuaauggcacucuuagaucc

SEQ ID NO: 3750 - RNA, 84 nt, Mus musculus
uguguguguucuugugugugcaugugcauguguguauaugaauauacauauacauacacacauacacacgcacguacacacaca

SEQ ID NO: 3751 - RNA, 94 nt, Mus musculus
guaugugcauguguguuugugugugcguacauguacauguguguauaugaauaugcauauacaugagagcauacauagacacacgugcaugugc

SEQ ID NO: 3752 - RNA, 84 nt, Mus musculus
uguguguauguguugauguguguguacauguacaugugugaauaugauauacauacaugcacacauaagacacauaugagcaca

SEQ ID NO: 3753 - RNA, 89 nt, Mus musculus
uguguauauguguuuauguguguguacauguacaugugugaauaugaugauauauacauacacgcacacauaagacacauaugagcaca

SEQ ID NO: 3754 - RNA, 76 nt, Mus musculus
guguguguguguguguguguguguguguauguguguguaguauaugugcacacacacacauacguacccaugcaug

SEQ ID NO: 3755 - RNA, 73 nt, Mus musculus
cugugugcguaagugccugcauguauaugcguguauauuuuaugcauauacauacacacaccuacacacacau

SEQ ID NO: 3756 - RNA, 83 nt, Mus musculus
ugugcccgugugcguaagugccugcauguauaugcguguauauuuuaugcauauacauacacacaccuacacacacaugcaca

SEQ ID NO: 3757 - RNA, 83 nt, Mus musculus
ugugccugugugcguaagugccugcauguauaugcguguauauuuuaugcauauacauacacacaccuacacacacaugcaca

SEQ ID NO: 3758 - RNA, 83 nt, Mus musculus; identical to SEQ ID NO: 3756

SEQ ID NO: 3759 - RNA, 83 nt, Mus musculus; identical to SEQ ID NO: 3757

SEQ ID NO: 3760 - RNA, 83 nt, Mus musculus; identical to SEQ ID NO: 3757

SEQ ID NO: 3761 - RNA, 83 nt, Mus musculus; identical to SEQ ID NO: 3756

SEQ ID NO: 3762 - RNA, 83 nt, Mus musculus; identical to SEQ ID NO: 3757

SEQ ID NO: 3763 - RNA, 83 nt, Mus musculus; identical to SEQ ID NO: 3757

SEQ ID NO: 3764 - RNA, 83 nt, Mus musculus; identical to SEQ ID NO: 3757

SEQ ID NO: 3765 - RNA, 73 nt, Mus musculus
ccgugugcguaagugccugcauguauaugcguguauauuuuaugcauauacauacacacaccaacacacacau

SEQ ID NO: 3766 - RNA, 97 nt, Mus musculus
ccuuugugcauaagugcgugcauguauauguguguauauuuuaugcauauacauacacacaccuauacacacaugcacacagacaugcgagaauggc

SEQ ID NO: 3767 - RNA, 85 nt, Mus musculus
ccugugugcauaagugcgcgcauguauaugcguguauauuuuaugcauauacauacacacaccuacacacacaugcacacagaca

SEQ ID NO: 3768 - RNA, 87 nt, Mus musculus
gccugugugcauaagugugagcauguauauguguguauauuuuaugcauauacauacacacaccuauauacacaugcacacagacau

SEQ ID NO: 3769 - RNA, 120 nt, Mus musculus
acggcuacauagagaaauccuguacccagaaaucgaacggggguggguguguguguagguguguguguguguauguauguauauacacacacacaccuacacacagcuuuuuuggaauuu

SEQ ID NO: 3770 - RNA, 120 nt, Mus musculus
gucuugugcaugcauauauauauauguguguguguauauauauauacauauauauacauacauacacauguauauguauauauacauacacacacauauauauauucauguauauauaua

SEQ ID NO: 3771 - RNA, 121 nt, Mus musculus
uuuucacuuuuguuuuucucauguauauguguaugugugcgguguacauaauuauaucuaugugugcauguauguggacauaagugugugcauguauaugugugugugugguguacauaau

SEQ ID NO: 3772 - RNA, 78 nt, Mus musculus
auaagaaacuuggcgugucgugacugauguacugauaagaaacucagugugauaugacugaugugcgugugucugucu

SEQ ID NO: 3773 - RNA, 75 nt, Mus musculus
cagugcucuucuuggacuggcacuggugaguuaaacuaaauacaaccaguaccuuucugagaagaguaaagcuca

SEQ ID NO: 3774 - RNA, 67 nt, Mus musculus
gugcuuuacguaguauagugcuuuucacauuaaacaaaaagugaaaggugccauacuauguauagga

SEQ ID NO: 3775 - RNA, 73 nt, Mus musculus
gagggggaagacgggagaagagaagggagugguuuuugggugccucacuccuccccucccgucuuguucucuc

SEQ ID NO: 3776 - RNA, 67 nt, Mus musculus
cucgucaggcucaguccccucccgauaaaccucaaaauagggucuuaccuagggggcuggcggcgua

SEQ ID NO: 3777 - RNA, 73 nt, Mus musculus
acuuggagagaggcuggccgugaugaauucgauucaucuaaacgagucauacacggcucuccucucuucuagu

SEQ ID NO: 3778 - RNA, 128 nt, Mus musculus
cagccagcucugaucucgcccucccugagggguccuguacugagcugccccgagguccuucacugugcucagcucggggcagcucaguacaggaugcgucagggugggagacaacggggaacaagcca

SEQ ID NO: 3779 - RNA, 82 nt, Mus musculus
ugguacuuggagagugguuaucccuguccucuucgcuucacucaugccgaaucguacagggucauccacuuuuucaguauca

SEQ ID NO: 3780 - RNA, 109 nt, Mus musculus
uucgggugagagugagaauccucucucccagauaauagcacucucaaacaaguuuccauguuguuugaaaggcuguuucuuggucagaagacucucaauuucuucugga

SEQ ID NO: 3781 - RNA, 107 nt, Mus musculus
acugcugcaguggcagcuugguugucauaugugugaugacacuuucuaaagucuuccagaaugacaccacauauauggcagcuaaacuguuacauggaacaacaagu

SEQ ID NO: 3782 - RNA, 84 nt, Mus musculus
uggaaaguucauuguucgacaccauggaucuccaggugggucacguuuagauauacaccaaccuggaggacuccaugcuguuga

SEQ ID NO: 3783 - RNA, 86 nt, Mus musculus
aauugacuuagcugggaaguggggaacccuuccaugaggaguagaacacuccuuaugcaagauucccuucuaccugacugaguuga

SEQ ID NO: 3784 - RNA, 83 nt, Mus musculus
cgccagggccuuguacaugguaggcuuucauucauuuuuugcacauucggugaagguccuacugugugccaggcccugugcca

SEQ ID NO: 3785 - RNA, 85 nt, Mus musculus
uugauacuugaaggagagguuguccguguugucuucucuuuauuuaugaugaaacauacacgggaaaccucuuuuuuaguaucaa

SEQ ID NO: 3786 - RNA, 63 nt, Mus musculus
aaagaaguugcccauguuauuuuucgcuuuuauuugugacgaaacaaacauggugcacuucuu

SEQ ID NO: 3787 - RNA, 79 nt, Mus musculus
aguguucgaauggagguugcccaugguguguucauuuuauuuaugaugaguauuacauggccaaucuccuuucggcacu

SEQ ID NO: 3788 - RNA, 113 nt, Mus musculus
uuggaagcagauggccgauaauuacugaaacaauucugauuuuguacaaaaaaauucucaacgagguuaguuaaugguuaucaugauugcaacauggccaauuccuuucaucu

SEQ ID NO: 3789 - RNA, 84 nt, Mus musculus
ccugcccccgccccagcagcacacugugguuuguacggcacuguggccacguccaaaccacacugugguguuagagcgagggua

SEQ ID NO: 3790 - RNA, 125 nt, Mus musculus
ucaucggugccucccauacccucgcucuaacaccacagugugguuuggacguggccacagugccguacaaaccacagugugcugcuggggcgggggcaggacuggggugggucgagaggaagaca

SEQ ID NO: 3791 - RNA, 79 nt, Mus musculus
gggugggcagcuguuaagacuugcagugauguuuagcuccucugcaugugaacaucacagcaagucugugcugcugccu

SEQ ID NO: 3792 - RNA, 92 nt, Mus musculus
cuccucugcucccccucucuaauccuugcuaucugggugcuuagugcuaucucaaugcaaugcaccugggcaaggguucagagaaggugagc

SEQ ID NO: 3793 - RNA, 109 nt, Mus musculus
cuucugcucugcucauccucucuaauccuuugucccugggugaaaaugcuauuuguaugcaaugcacccgggcaaggauuuggggaaggugagccugaucugcauggag

SEQ ID NO: 3794 - RNA, 71 nt, Mus musculus
ugcccuagcagcgggaacaguacugcagugaguguuuggugcccuggaguauuguuuccacugccugggua

SEQ ID NO: 3795 - RNA, 79 nt, Mus musculus
uccuguugggagacccuggucugcacucuaucuguaaacuuacugaagggagagcagggcaggguuucccauacagagg

SEQ ID NO: 3796 - RNA, 90 nt, Mus musculus
aaauugaugcacccagugggggagccaggaaguauugauguuucugccagguuagcgucaacacuugcugguuuucucucuggaguauca

SEQ ID NO: 3797 - RNA, 75 nt, Mus musculus
gugguucuuuacuccagaauguggcaaucaugcauaauuaaaugugauugacauuucuguaauggaguaacacau

SEQ ID NO: 3798 - RNA, 79 nt, Mus musculus
gauacccaccaugccuuuugcucugcacucaguaaauaauaauuugugaauguguagcaaaagacaggauggggaucca

SEQ ID NO: 3799 - RNA, 96 nt, Mus musculus
cagauuugcuuuuucucuuccaugccuugaguguaggaccguugacaucuuaauuacccucccacacccaaggcuugcaggagagcaagccuucuc

SEQ ID NO: 3800 - RNA, 74 nt, Mus musculus
uacuugaggagaaauuauccuugguguguuggcucuuuuggaugaaucauacaaggauaauuucuuuuugagua

SEQ ID NO: 3801 - RNA, 67 nt, Mus musculus
ugggccaagggucacccucugacucuguggccaaggguagacaggucagaggucgauccugggccua

SEQ ID NO: 3802 - RNA, 90 nt, Mus musculus
gccaaaaucagagaagggauucugauguuggucacacuccaagaguuuuaaaaugaguggcgaacacagaauccauacucugcuuauggc

SEQ ID NO: 3803 - RNA, 85 nt, Mus musculus
ggaucucagacgucucggggaucaucaugucacgagauaccacugugcccuugugacagauugauaacugaaaggucugggagcc

SEQ ID NO: 3804 - RNA, 76 nt, Mus musculus
ugcuuaaugagaaguugcccgcguguuuuucgcuuuauaugugacgaaacauucgcggugcacuucuuuuucagca

SEQ ID NO: 3805 - RNA, 78 nt, Mus musculus
caccuagggaucuuguuaaaaagcagagucugauugaggggccaagauucugcauuuuuagcaagcucucaagugaug

SEQ ID NO: 3806 - RNA, 121 nt, Mus musculus
ccucucuucccaaaacuaaacaggaucuaucaugguggcacggagucagcuagauguugucucuugcuaucccugugcuaguuccauguuuuagaagcaaagugauacuggggaggagagg

SEQ ID NO: 3807 - RNA, 78 nt, Mus musculus
gugugauguaucacuugaggauguaccacccauuuaacaggaaacaugcuugguacaucuuugagugagauaacacac

SEQ ID NO: 3808 - RNA, 98 nt, Mus musculus
gugcucuuguggcccaugaaaucaagcuugggugagaccuggugcagaacaggaaggcgacccauacuugguuucaguggcugcaagaaugacugcau

SEQ ID NO: 3809 - RNA, 83 nt, Mus musculus
acacuauauuauguauaaauguauacacacuucuauauauguccacauauaugcgguguguguauuauacagguauaggugug

SEQ ID NO: 3810 - RNA, 78 nt, Mus musculus
ugcgggcgugugagugugugugugugagugugugucgcuccaaguccacgcucaugcacacacccacacgcccgcacg

SEQ ID NO: 3811 - RNA, 81 nt, Mus musculus
acucuuuggauacaguuguucaaccaguuacuaaucuaacuaauuguaaccuguugaacaacugaacccaaagggugcaaa

SEQ ID NO: 3812 - RNA, 81 nt, Mus musculus
agucagaaaugagcuuauucauaaaagugcaguauggugaagucaaucuguaauuuuauguauaagcuagucucugauuga

SEQ ID NO: 3813 - RNA, 96 nt, Mus musculus
ugauauuaugccaugacauugugucaauaugcgaugauguguugugauggcacagcgucaucacguggugacgcaacaucaugacguaagacauca

SEQ ID NO: 3814 - RNA, 79 nt, Mus musculus
gcugaugcuggcggugaugccgauggugcgagcugaaaaugggcugcuacgucaucgucgucaucguuaucaucaucau

SEQ ID NO: 3815 - RNA, 88 nt, Mus musculus
ugcuguccacaguguauuugauaagaugacauaggagaggaacuucuuucaccuuugugucaguuuaucaaacccauaccuggaugac

SEQ ID NO: 3816 - RNA, 92 nt, Mus musculus
ucgggaggggcgggagggggguccccggugcucggaucucgagggugcuuauuguucgguccgagccugggucucccucuuccccccauccc

SEQ ID NO: 3817 - RNA, 98 nt, Mus musculus
aggaacagcuauguacugcacaacccuaggagggggugccauucacauagaguauaauugaauggcgccacuaggguugugcaguguacagccuacac

SEQ ID NO: 3818 - RNA, 85 nt, Mus musculus
cauucuuucaguguugaaacaaucucuacugaaccaagcuccaaagcgaguucacuggaguuuguuucaguauugcaggagugcu

SEQ ID NO: 3819 - RNA, 84 nt, Mus musculus
cucgguaagugggaagaugguaagcugcagaacauguguguuucucaugucauaugucugcugaccaucaccuuugggucucug

SEQ ID NO: 3820 - RNA, 69 nt, Mus musculus
cuggcuggggaaaaugacuggauagaaaacauuauucuauucauuuacuccccagccuacacaugaaag

SEQ ID NO: 3821 - RNA, 94 nt, Mus musculus
agaacagggucuccuugaggggccucugccucuauccaggauuauguuuuuaugaccaggaggcugaggucccuuacaggcggccucuuacucu

SEQ ID NO: 3822 - RNA, 99 nt, Mus musculus
cugauucugccugcguggagcgggcacagcugugagagcccccuagguacagcggggcugcagcgugaucgccugcucacgcacaggaagugacgacag

SEQ ID NO: 3823 - RNA, 92 nt, Mus musculus
guggguacuggccucggugcugguggagcagugagcacgccauacauuauaucugugacaccugccacccagcccaaggccccuaggcccac

SEQ ID NO: 3824 - RNA, 66 nt, Mus musculus
gguaagugugccucgggugagcaugcacuuaauguagguguaugucacucggcucggcccacuacc

SEQ ID NO: 3825 - RNA, 97 nt, Mus musculus
uguaugugcauguguguauaguugugugugcauguucaugucuauauuugaauauacauaacauacacacacacguauaaacgcaagcacacauaca

SEQ ID NO: 3826 - RNA, 87 nt, Mus musculus
ugugcauguguguauaguugugugugcauguucaugucuauauuugaauauacauaacauacacacacacguauaaacgcaagcaca

SEQ ID NO: 3827 - RNA, 87 nt, Mus musculus; identical to SEQ ID NO: 3826

SEQ ID NO: 3828 - RNA, 87 nt, Mus musculus; identical to SEQ ID NO: 3826

SEQ ID NO: 3829 - RNA, 97 nt, Mus musculus
cauguaugugcauguguguauaguugugugugcauguucaugucuauauuugaauauacauaacauacacacacacguauaaacgcaagcacacaca

SEQ ID NO: 3830 - RNA, 109 nt, Mus musculus
uuccuccauguaugugcauguguguauaguugugugugcauguucaugucuauauuugaauauacauaacauacacacacauguauaaacgcaagcacacauacacaga

SEQ ID NO: 3831 - RNA, 87 nt, Mus musculus; identical to SEQ ID NO: 3826

SEQ ID NO: 3832 - RNA, 87 nt, Mus musculus; identical to SEQ ID NO: 3826

SEQ ID NO: 3833 - RNA, 87 nt, Mus musculus; identical to SEQ ID NO: 3826

SEQ ID NO: 3834 - RNA, 87 nt, Mus musculus; identical to SEQ ID NO: 3826

SEQ ID NO: 3835 - RNA, 87 nt, Mus musculus; identical to SEQ ID NO: 3826

SEQ ID NO: 3836 - RNA, 87 nt, Mus musculus; identical to SEQ ID NO: 3826

SEQ ID NO: 3837 - RNA, 97 nt, Mus musculus
augaauguaugugcauguguauauaguuuugugugcaugugcaugugugucuauuaauguacauauacauacacacaaacauauacacgcaugcgca

SEQ ID NO: 3838 - RNA, 109 nt, Mus musculus
ccuccauguaugugcauguguguauaguuguguguggauguguguauuugcauauaaauaacauacacacacacacacaaguaaacacaagugcacaaacagacacagg

SEQ ID NO: 3839 - RNA, 121 nt, Mus musculus
cagcccgggauuuguguguugcuugcucuauauguguguauacuugugugugcauguauauguguguauaugaauauacauauacauacacacccauauacacacgcaugcaugcacacac

SEQ ID NO: 3840 - RNA, 86 nt, Mus musculus
gugcauguguguauacuugugugugcauguauaugugucuauaugaauauacauauacauacacacccauauacacacgcaugcac

SEQ ID NO: 3841 - RNA, 119 nt, Mus musculus
gccugggauucaugggcuguacccuauauaugggcaggugugugucuugugugugcauguucauuuguguauaugaauaugaauauacacacacuuacacacucaugcacacacacaca

SEQ ID NO: 3842 - RNA, 121 nt, Mus musculus
uguaugugccuguguguauaguugugugugcaugugcauguguguauaugaauauacauauacauacacacacacguauaaacgcaagcacaaacacacacagaggaauggcacucguuga

SEQ ID NO: 3843 - RNA, 123 nt, Mus musculus
caugugugcuuacuuguaugugcauuguauguguugacaugauauacauaacauaaacacacguguaucugcaagcacacacacacaggaaaaauugcauucauuuauacguuugaaugauau

SEQ ID NO: 3844 - RNA, 125 nt, Mus musculus
ugugaugcccaccaaaaauaugcauggguguauaguugagugcauauucauuucucuauaugaauaugcauauacacacaugcacacacacacacacucacacacaggaaugacacucguuuauc

SEQ ID NO: 3845 - RNA, 127 nt, Mus musculus
augugaugcccaccaauaaugugcauguguguauaguugugugcauauucauuucucuauaugacuaugcauauacacacaugcauacaaacucacauacaggaaugacagucauauauccuuuuga

SEQ ID NO: 3846 - RNA, 121 nt, Mus musculus
agcaugcgauucaugugauguccaccaagaaugugcauguguguauaguuguguacauauucacuuuuguauaugaauaugcauauacucacaugcaaacauacucccacgaauggcccga

SEQ ID NO: 3847 - RNA, 127 nt, Mus musculus
ucuuaugcccaccaaaaaugugcauguguguauaguugugugcauauucacuucucuauaugaauaugcauauacacgcaugcaaacacauucauaggaauggccagagcuauaucucaguuaggag

SEQ ID NO: 3848 - RNA, 98 nt, Mus musculus
guuugugcaugugcguauaguugugugugcauguauauguguguauaugaauauacauauacauacacacccauauauacacgcauucauaugaacac

SEQ ID NO: 3849 - RNA, 98 nt, Mus musculus
uguaugugcauguguguauaguuuugugugcaugugcauguguguauaugaauagacauauacauccacacaaacauauacaagcaagcacagauaca

SEQ ID NO: 3850 - RNA, 98 nt, Mus musculus
auauuugcauguguguauaguuuugugugcaugugcauguguguauaugaauauacauauacauccacacaaacauauacaagcaugcacagauauac

SEQ ID NO: 3851 - RNA, 54 nt, Mus musculus
uacauuuguguguggauguguguguaaauguaugugcaucccacagcacaugug

SEQ ID NO: 3852 - RNA, 96 nt, Mus musculus
ugcaugugcauguguguauaguugugugugcauguuuauguguguauuugaauauacauaacauacacacacacguauaaacacaagcacacacac

SEQ ID NO: 3853 - RNA, 87 nt, Mus musculus
gugcauguguguauaguugugugugcauguucaugucuauauuugaauauacauaacauacacacacacacguauaaacgcaagcac

SEQ ID NO: 3854 - RNA, 87 nt, Mus musculus; identical to SEQ ID NO: 3853

SEQ ID NO: 3855 - RNA, 100 nt, Mus musculus
gguuuggaggugggccugacaucccugaguguauguggugaaccugaacuugcccuggguuuccucauauccauucaggagugucagcugccucuucgcu

SEQ ID NO: 3856 - RNA, 98 nt, Mus musculus
uggcaggccaggaagaggaggaagcccuggaggggcuggaggugauggauguuuuccuccgguucucagggcuccaccucuuucgagccguagagcca

SEQ ID NO: 3857 - RNA, 100 nt, Mus musculus
gauggugaucuagcccuuuaguuuugagguugguguacugugugugaguauacauauuuaucacacacagucacuaucuucgaaagugagggugcacauc

SEQ ID NO: 3858 - RNA, 91 nt, Mus musculus
uggagccugaggggcucacagcucugguccuuggagcuccagagaaaauguugcuccggggcugaguucugugcaccccccuugcccucca

SEQ ID NO: 3859 - RNA, 100 nt, Mus musculus
ggccuagucaucacccugagccuugcacugagaugggagugguguaaggcucagguaugcacagcucccaucucagaacaaggcucgggugugcucagcu

SEQ ID NO: 3860 - RNA, 84 nt, Mus musculus
ugcggcccagggacuggugcggaaagggcccacaguggacuugguacacuguaugcccuaaccgcucagucccugggucuggca

SEQ ID NO: 3861 - RNA, 89 nt, Mus musculus
cuuugccugaaugcaugacucuacaaccuuaggacuugcagaauuaaaggaaugccguccugagguuguugagcugugcguuucugggc

SEQ ID NO: 3862 - RNA, 78 nt, Mus musculus
gagccuucagugaugauuagcuucugacuuucguucuucugaauuugcugaagccagaugccguuccugagaagggga

SEQ ID NO: 3863 - RNA, 84 nt, Mus musculus
guggacugugacuugcagagcugugcuccaauaugagagauggccaugcacccgugucucggugcaaggacuggagguggcagu

SEQ ID NO: 3864 - RNA, 74 nt, Mus musculus
cuauggcuuuggacugugaggugacucuuggugugugauggcuuuucagcaagguccuccucacaguagcuaua

SEQ ID NO: 3865 - RNA, 109 nt, Mus musculus
agaagugggcaucugcugacaugggggccgaagucaggcgccaggaagcgggcacuuugcaucuuaucuccggaacaucgauccucuugacagccuugggugucaggcu

SEQ ID NO: 3866 - RNA, 110 nt, Mus musculus
gggcaucugcugacaugggggccgaagucaggcgccaggcaucgggcacucuggaucuuaucucuggaacauugauccuccuugacagccuugggggucaggcugggcuc

SEQ ID NO: 3867 - RNA, 87 nt, Mus musculus
gggggauuuaacaaagaacaaaaaaggugggcaucugcugacaugggggcagaagucaggcucuaggcagcagguacucuucaucuu

SEQ ID NO: 3868 - RNA, 110 nt, Mus musculus
gcagccucgcuggcaggcagcuccagaguguggcuguccucaucacucucccuaagcagguagauggguuucaguucacucgcaguccagggccuccagcgggacaguug

SEQ ID NO: 3869 - RNA, 96 nt, Mus musculus
gccgucggcaucuggcacugugguuccugcaugaaaacaguggccggcggggccuggaccuacaacaccaccucugcagucacagugaagucugcc

SEQ ID NO: 3870 - RNA, 109 nt, Mus musculus
ugggaaguccagcugggaggcugcaguggacccaggcuaaaagccaagcuuuucugcacugcaguggaugccugcuguaagcuguguccuccugggcugcauggagccc

SEQ ID NO: 3871 - RNA, 109 nt, Mus musculus; identical to SEQ ID NO: 3870

SEQ ID NO: 3872 - RNA, 86 nt, Mus musculus
guagggcaaucugucuuuaaguagggauaaauuacucuugaacaaaaugauccuagauaguuuucccuucaagucaagcgucuugc

SEQ ID NO: 3873 - RNA, 86 nt, Mus musculus
uguagggcaaucugucuuuaaguagggauaaauuacucuugaacaaaaugauccuagauaguuuucccuucaagucaagugucuug

SEQ ID NO: 3874 - RNA, 109 nt, Mus musculus
gccacagcaggugcuuauauugcuucccagacggugaagaaaguaauagagaucaacccguaccuucugggcaccauggcugggggugcagcggauugcagcuucuggg

SEQ ID NO: 3875 - RNA, 89 nt, Mus musculus
auagucugacacacauuuuacacuauccuggaaugcagcaaugaauccuggguuauuguuucagucugucauuguauucuuggaaagug

SEQ ID NO: 3876 - RNA, 75 nt, Mus musculus
gaaagggcagugaagaaaaguaggggcuugcuuggggagagcaccucgcaggcgacuacuuauuccagcucgccc

SEQ ID NO: 3877 - RNA, 109 nt, Mus musculus
uguguuuuuguggagcuaauuggcuguauuaaagugcuaguaagaaacauucuccuccagcuggagagauggcucagcuguuaaaggcuaggcucacaaccaaaauaua

SEQ ID NO: 3878 - RNA, 78 nt, Mus musculus
gcugauuuauuuuugcuuucuuccuugggucugcuuugaauauuccugaagagaggcagaaaauguuauauuuaauau

SEQ ID NO: 3879 - RNA, 109 nt, Mus musculus
aggguggcagggccacaaccagcgcagacuggcgcgccccagggaucucugggugaguaucucuuugagcgccucacucucaagcacaacuaggaggccucugccuucc

SEQ ID NO: 3880 - RNA, 109 nt, Mus musculus
gguggcagggccacaaccagcgcagacuggcgcgccccagggaucucugggcgaguaucucuuugagcgccucacucucaagcacgacuaggaggccucugugccuucc

SEQ ID NO: 3881 - RNA, 109 nt, Mus musculus; identical to SEQ ID NO: 3880

SEQ ID NO: 3882 - RNA, 89 nt, Mus musculus
aguuguaggcaugcucauuacagccacauccgaaaguuuuccuggcuagggcagcuuucagauguggcuguaaugagcaugcucccagc

SEQ ID NO: 3883 - RNA, 70 nt, Mus musculus
aaaggccagcucaggcaucgcuuucaacccaagaccaggcugaaaauguugccugaagcagucucugccu

SEQ ID NO: 3884 - RNA, 109 nt, Mus musculus
ucacgaggaauccuagauugggcauaggugacugaaguacacagcugccuuucuuacaaaggcacugguuaccuugguccuggucaccggcucggcuaucugcuacucg

SEQ ID NO: 3885 - RNA, 88 nt, Mus musculus
ggucugucgcggugccugaagcuguccccgagccacgcuuccugcuuucccgggcuugcugcuugcgugugcuugcugugggcagcuu

SEQ ID NO: 3886 - RNA, 109 nt, Mus musculus
gaguggggauguguccuggauguuggucuugacaggucucagaggugacuaccacacauugaagggguggcgguaacauccugguccuguggagacugucauagucucc

SEQ ID NO: 3887 - RNA, 109 nt, Mus musculus
ucaucucugcccucacuguaagggagggugguggcuaugugggugggacagggauguucaguugcuaaagacauucucguuuccuucccucaguguccccagaugguga

SEQ ID NO: 3888 - RNA, 79 nt, Mus musculus
uucacugggaguaaggcuccuuccugugcuugcaggggagaaauacgaacugcacgcgggaaccgaguccacccccagu

SEQ ID NO: 3889 - RNA, 109 nt, Mus musculus
guggagcaucuaccuugagcaaguaauuagccgcugaaauagauggauuguauagaugagguucuaucuauuaaagaggcuagccacuuaucaagugcuaacagcccac

SEQ ID NO: 3890 - RNA, 109 nt, Mus musculus
cgggacaaggugaguggggugguuggcauggguugcccauggggacucgacgcugugcccacagccuccugauguccuccucacgcaugcccacccuuuaccccgcucc

SEQ ID NO: 3891 - RNA, 109 nt, Mus musculus
agacugguuaaugauaacaaugcaucauaaaaccuucagaaggaaagaauguuguggaccauuuuuuuuuguguguggcaguuuuaaguuauuaguuuucaaaaucagu

SEQ ID NO: 3892 - RNA, 77 nt, Mus musculus
gcugggagcuagaggauguggucagcugcaaggaucuuccucagacaugugcucugcuccuagggauuguugacuac

SEQ ID NO: 3893 - RNA, 82 nt, Mus musculus
augucccaguaguggugggagguggggugggcacagagggaaugacuucuuucuccugcaguccucccuaccucccuaacau

SEQ ID NO: 3894 - RNA, 84 nt, Mus musculus
agagaaacccugucucaaaaaacaaaaaaacaaacaaaauuacuuuuaguagguuuauuuuguuuuuugagauggcuuuuuuuu

SEQ ID NO: 3895 - RNA, 73 nt, Mus musculus
ggcaugcagucaugccgcuugccuacgcuugugugagcaugggcaugcggucauaguuguugcgggcaauucg

SEQ ID NO: 3896 - RNA, 109 nt, Mus musculus
cuguguuugaaauggggacugcccucaaggagcuuacaaucuagcuggggguagaugacuugcacuugaacacaacuagacugugagcuucuagagggcaggggccuua

SEQ ID NO: 3897 - RNA, 88 nt, Mus musculus
ugucccguuucucugcuucuacucagaagugcucugagcauagaacuguccuguuugagcagcacuggggaggcagaggcaggaggau

SEQ ID NO: 3898 - RNA, 110 nt, Mus musculus
cucucucgucaaauagaagccaagucuuggggagaguugagcuuggugugaaaacugacauaccccuucaacucuuuagaacuuagguaucugaaguggaguggauggag

SEQ ID NO: 3899 - RNA, 82 nt, Mus musculus
cauguuccuaacuuugaaucucuucuuagggugcuucaggcaaagcuggggacccggggagagauguaagucuggggagaug

SEQ ID NO: 3900 - RNA, 109 nt, Mus musculus
ucuccgcuucuccuucacccgggcgguacccgcuccggcgccggcccgcgggacgccgcggcguccgugcgccgaugcgagucacccccggguguugcgaguucgggga

SEQ ID NO: 3901 - RNA, 108 nt, Mus musculus
ggccuauccggaggcccugauugguuagugagacuugauugacaugagcaccucccuuaggguuagagugcacugaaggcacacagcauagggcuuccaagaucgggu

SEQ ID NO: 3902 - RNA, 110 nt, Mus musculus
cgacgagggccggucggucgcccugcggugguugucuguguguguuugggucuugcgcugggggaggcggggucgaccgcucgcgggguuggcgcggucgcccggcgccg

SEQ ID NO: 3903 - RNA, 109 nt, Mus musculus
uuguccgcuaucacuguaccgucauuuuucagucucagacagagauaccuucucugaauucauagaagcugcucuccguuccgaagggauucagaagugauaaauccag

SEQ ID NO: 3904 - RNA, 88 nt, Mus musculus
acgcccccguguggcggaaggccgcggagggcaagauggcggcgggucgagcgccgccucuuccgcccggccgggugucgcacgaggc

SEQ ID NO: 3905 - RNA, 110 nt, Mus musculus
uuuaggugcuuaaagaacaguaucucggcuacagaaaaauguuuuugggugaugcuguggauguguuugaagccaggagaacagaagccaagaaguggcagaaugcaccc

SEQ ID NO: 3906 - RNA, 88 nt, Mus musculus
ggaagacagugcaauuaaaagggggaaaaaaguaccugggauguucugagaauuucauuuuucuuguuauugccacuccugcuuggaa

SEQ ID NO: 3907 - RNA, 71 nt, Mus musculus
uugaucuacguagauugguaccuaucauguaaaucauguaagcaugagagaugccauucuauguagauuaa

SEQ ID NO: 3908 - RNA, 65 nt, Mus musculus
ugcucuacucacaugguugcuaaucacgugaaguguaggugaaagccaccaugcuggguaaagua

SEQ ID NO: 3909 - RNA, 62 nt, Mus musculus
cuguauucagauuggugccugucauguuuauaagaaugaaagacaccaagcugaguagagua

SEQ ID NO: 3910 - RNA, 77 nt, Mus musculus
ugcagugcuguguucagacugguguccaucaugugaaauauuugugaaagacaucaugcugaauagaguaaggccca

SEQ ID NO: 3911 - RNA, 100 nt, Mus musculus
ggcugggcaaggugcggggcuagggcuaacagcagucuuacugacgguuuccuggaaaccacacacaugcuguugccacuaaccucaaccuuacucgguc

SEQ ID NO: 3912 - RNA, 81 nt, Mus musculus
ugggugcgugaggugguugaccagagagcacacgcuauauuugugccguuugugaccugguccacuaacccucaguaucua

SEQ ID NO: 3913 - RNA, 98 nt, Mus musculus
ggauuauaauaaauuaaaugccuaaacuggcagagugcaaacaauuuugacucagaucuaaauguuugcacuggcuguuuaaacauuuaauuuguucc

SEQ ID NO: 3914 - RNA, 119 nt, Mus musculus
cgggaggaugccucggugcggggcgcgucgccccccucaggccaccagagcccggauaccucagaaauucggcucugggucuguggggagcgaaaugcaacccaaaccccguuuccccg

SEQ ID NO: 3915 - RNA, 76 nt, Mus musculus
uggcaaguggaggagcagcagggugaaacugacacagugcuggugaguuucacuuugcugcuccuccugacuccca

SEQ ID NO: 3916 - RNA, 76 nt, Mus musculus
gcccggcuccgggucucggcccgcacgguccggccggccaugcuggcggggcuggggccgggacagagcccguggc

SEQ ID NO: 3917 - RNA, 120 nt, Mus musculus
aaugauggaggugcaggcguuuccuggggauuaaugaccagcugggaagaaccaguggcccucggcucugccucccagccagccauuaacuccaaggaaaugucuuuugcugaggucguu

SEQ ID NO: 3918 - RNA, 108 nt, Mus musculus
ucaacacaaucugaaucuuggaggcaggugcucacauguccuccuccaugcuuauaaauacauggaggaggccauaguggcaacugucaccaugauugauuucguugg

SEQ ID NO: 3919 - RNA, 107 nt, Mus musculus
agaauccauauagguuuuuacucaugcaccaugguugucugagcacauaacaugcuugucugcucauacccuaugguuccugaagaggaaucuuaacugucuacugc

SEQ ID NO: 3920 - RNA, 94 nt, Mus musculus
gccaccuucugugcccccagcaccacgugucugggccacgugagcaacgccacgugggccugacguggagcuggggccgcaggggucugauggc

SEQ ID NO: 3921 - RNA, 97 nt, Mus musculus
gguccuauuauuugcaaucaguaacaaagauucauccuugugucaaucauacaacacggagagucuuugucacucaguguaauuaauagccuucacc

SEQ ID NO: 3922 - RNA, 95 nt, Mus musculus
cccuacacauccaucuuugagguuacaacuuccccaguagacuguuuccugacauuccuugugaguuguuccucaccuggaagaugugguggcgg

SEQ ID NO: 3923 - RNA, 77 nt, Mus musculus
ugcagugcucuauucagauuagugccagucaugugaaauacauaugacuggcaccauucuggauaauguaaugcuca

SEQ ID NO: 3924 - RNA, 81 nt, Mus musculus
aacuuguuagaagguuacuuguuaguucaggaccucauuacuuucugccugaacuauugcaguagccuccuaacugguuau

SEQ ID NO: 3925 - RNA, 77 nt, Mus musculus
gugugcauuugcaggaacuugugagucuccuauugaaaauagacaggagacugacaaguucccgggaacacccacaa

SEQ ID NO: 3926 - RNA, 77 nt, Mus musculus
uuguggguguucccgggaacuugucagucuccugucuauuuucaauaggagacucacaaguuccugcaaaugcacac

SEQ ID NO: 3927 - RNA, 76 nt, Mus musculus
uuagcccugcggccccacgcaccaggguaagagagacucacuuccugcccuggcccgagggaccgacuggcugggc

SEQ ID NO: 3928 - RNA, 78 nt, Mus musculus
ucugugguacuauaccucaguuuuaucagguguucauuaaaaucaccugaaaauacugaggcuauguuucacugagca

SEQ ID NO: 3929 - RNA, 81 nt, Mus musculus
ucacgugcuauggauuucucugugaaucacuauaucaaaucuagugugguagugguuuacaaaguaauucauagugcuuca

SEQ ID NO: 3930 - RNA, 85 nt, Mus musculus
guagaggagauggcgcaggggacacaagguaggccuugcgggucuguggacccuuggacauguguccucuucucccuccucccag

SEQ ID NO: 3931 - RNA, 78 nt, Mus musculus
ugcaaugcuuuaucuaguuggaugucaagacacgugaaacuuaagugcaugacaccacacuggguagaggagggcuca

SEQ ID NO: 3932 - RNA, 76 nt, Mus musculus
uucuagguccagaggcuuauagcucuaagccuuggaugaaagaggcuuauggcuucaagcuuucggagcuggagac

SEQ ID NO: 3933 - RNA, 78 nt, Mus musculus
ugcacugcaauacucagauugauaugagucacuuccuauugcauguuacuccauccucucugaguagaguaaggcaca

SEQ ID NO: 3934 - RNA, 78 nt, Mus musculus
ugcaguacaauauucagagagauaacagucacaucuuuucuaaaguaacugugucuuuucugaauagaguaauguuca

SEQ ID NO: 3935 - RNA, 77 nt, Mus musculus
cagcaguaccaggagagaguuagcgcauuagugcaauaguuaguccugauuucuggguuuuucuaauggcugcucuu

SEQ ID NO: 3936 - RNA, 76 nt, Mus musculus
gcacuauaaugcugagagaaguagcaguuacuuuauucuauaaguaacugcaacagcucucaguauuguaaggcuc

SEQ ID NO: 3937 - RNA, 78 nt, Mus musculus
ugcaaugcauuacugagaauggguagcagucacuuuguacuaugaguaacugcaacaucucucaguauuguaagguuc

SEQ ID NO: 3938 - RNA, 122 nt, Mus musculus
ucauauaguauuaaaccgaacuguuuuccuuauagacacaauuuauuuuuacacacacacacacacacauauauauauauauguguguguguauguguguaaauaacaauguuaaaauagua

SEQ ID NO: 3939 - RNA, 120 nt, Mus musculus
auacucacagucucccagcuggugugagguugggccaggaugaaacccaaggcucuccgaggcuccccaccacacccugcugcugaagacugccuagcaaggcugugccgaguggugugg

SEQ ID NO: 3940 - RNA, 96 nt, Mus musculus
gcucuggggccuuugcagacgugggaaggucucugcuggccugaugcuucccccgucagcugagguuccccucugucugggaugcugccuugaguc

SEQ ID NO: 3941 - RNA, 120 nt, Mus musculus
uggaaccagccuggucuacauagcaacaucuaagccagccagggcuacauagugagaaccugccucaaaagcaaaacagcagucuuacuauguagcccuagauggccuagaacucccuau

SEQ ID NO: 3942 - RNA, 58 nt, Mus musculus
ucaggcuacagagcgagaaccugcuucaaaaacaccagacucacuauguagcccaagc

SEQ ID NO: 3943 - RNA, 121 nt, Mus musculus
ccuuccaaacaguaaaaacaaacaaacaaacagaccaaauuugucauuguuguuucgauuugcucuuuuuguuuguuugcuuuuguguuuugagacagggucuggcuuguauagcucaugc

SEQ ID NO: 3944 - RNA, 121 nt, Mus musculus
cugaagggacaaugaugcccacuguucucgggguagcuguguggaugguagaccggugacguacacuucauuuaugcuguaggucacccguuuuacuauccaccaacacccagaccaucug

SEQ ID NO: 3945 - RNA, 121 nt, Mus musculus
acaccuucugcuggagacaauauaaggacauuggaagaagggagucuagcucuugcuccuuugccugcuugcugcgugagaaugaguaacugcuagauccuuggacuuccauucacagcug

SEQ ID NO: 3946 - RNA, 98 nt, Mus musculus
uagaggcaggcagaucucugugaguucgaggccagccugcucaacagaaugaguucuagggcagccaggaacacacagagaaacccugucucaagaag

SEQ ID NO: 3947 - RNA, 120 nt, Mus musculus
gugagcuggaaucagccagcguuaccucaagguauuugaagaugcgguugaccaugguguguacgcuuuauuuaugacguaggacacauggucuacuucuucucaauaucacaucucgcc

SEQ ID NO: 3948 - RNA, 121 nt, Mus musculus
uuuuuuuucuuuuguuuauuuuguuugugacaguugucuguuauguguuccuggcuggcuugguacucauguguagcccaagcuagccucuaacucauggcagucauccugucucagucuc

SEQ ID NO: 3949 - RNA, 119 nt, Mus musculus
agccugcgccggagccggggucugagucccggucgcgcgggcgaggaacucauugaguugcgcgugcggccggugcucagucggcccggcuccgguacuccgcugccgcgcgcccugga

SEQ ID NO: 3950 - RNA, 85 nt, Mus musculus
gugaggacuggggagguggaggguagcaucauuagagccagagcucugucucagcucccucuccccccaccucuucucuccucag

SEQ ID NO: 3951 - RNA, 81 nt, Mus musculus
ucugggcagagcugcaggagagaagggcagggccggacaucucugccacccugccaccugcccugucuguucugcccacag

SEQ ID NO: 3952 - RNA, 82 nt, Mus musculus
cggccgccgggcgcacccgucccguucguccccggacguugcucucugccccgggaacgucgagacuggagcgcccgaacug

SEQ ID NO: 3953 - RNA, 98 nt, Mus musculus
cgauucuuguuugcguggggaggagggaggggaugggccaaguucccuaugccuggaacgcccuucccccccuucuucaccuggcgaacuccuacucg

SEQ ID NO: 3954 - RNA, 84 nt, Mus musculus
gucagcuauguggacucuagcugccaaaggcgcuucuccuucugaacagagcgcuuugcucagccaguguagacauggccugau

SEQ ID NO: 3955 - RNA, 60 nt, Mus musculus
ugcugagcuaauucccuaacugcuauguggagcugcaguuagggaauuagcucagcagua

SEQ ID NO: 3956 - RNA, 86 nt, Mus musculus
ccuggcauauagcagguccucaauaaguauuuguugaaaaaauaaaugaagcaacaaaucuuauuugagcaccuguuauguggagg

SEQ ID NO: 3957 - RNA, 117 nt, Mus musculus
agaaucaagggaugggagguuacccauggcucuuacugaagacuagcaguuauacacuguagcuguugguuucaagcagacgccuagagaacugucuuccagugguuuauuagcuac

SEQ ID NO: 3958 - RNA, 98 nt, Mus musculus
gagggguuaagaguucauucggcuguccagauguacccaaguacccuguuauuuggcaauacauacaucugggcaacugauugaacuuuucgcuucuc

SEQ ID NO: 3959 - RNA, 79 nt, Mus musculus
cagucuccaccaccuccccugcaaacguccagugaugcagagguaauggacguuggcucugguggugauggacaguccg

SEQ ID NO: 3960 - RNA, 107 nt, Mus musculus
acacggguaaggggcuggccugcaguggggcugggagggcaggccuaggugagcucagccucaaaggccuccuucucugcaggcucucagguccucagaaucaggga

SEQ ID NO: 3961 - RNA, 73 nt, Mus musculus
gaaaagguagauagaacaggucuuguuugcaaaauaaauucaagaccuacuuaucuaccaacagccauugccu

SEQ ID NO: 3962 - RNA, 65 nt, Mus musculus
gaauauggaggucucugucugacuuagaauagcuggcugagucugaucguucaccuccauacaac

SEQ ID NO: 3963 - RNA, 66 nt, Mus musculus
caacauggaggucucugucugacuuaggauagcuggcuaaguccgaucguuccccuccauacaacc

SEQ ID NO: 3964 - RNA, 80 nt, Mus musculus
uggauauauuucuacucuugaccaaaguuuuguaagaaacaauacagaauuuggggacgggagggaggauacuuugagaa

SEQ ID NO: 3965 - RNA, 83 nt, Mus musculus
ccagagcggagagguaucugcugcgccugagaugaguaaacugucguuucgggcgcgggcgcuggacgccucgaagccgcugc

SEQ ID NO: 3966 - RNA, 81 nt, Mus musculus
ucuuuguucucucuccccuaccaccugccucuucccugcuguggagcaggcaagggagagggugaagggagggccagccag

SEQ ID NO: 3967 - RNA, 79 nt, Mus musculus
cccacaccuuuuccucuucuucuuggccggguuggcuccgccagcuccccccgaggaggacgaggaggaggaggaauga

SEQ ID NO: 3968 - RNA, 81 nt, Mus musculus
aaggcuuucccacacucauuacagugaugucuuuuggaacgaccauggacucucugauggugggugaggaggagggcccga

SEQ ID NO: 3969 - RNA, 79 nt, Mus musculus
auucuccgugcuuuggauggagaaagaggggggaagugcgagcuccuucaacucguucuguccggugaggagugaucca

SEQ ID NO: 3970 - RNA, 83 nt, Mus musculus
guaugaacauaggucaagguucacaggggaucaagaaauauuauucuuguauaaucuguuuacuuugaccuaaauacuagcuu

SEQ ID NO: 3971 - RNA, 96 nt, Mus musculus
aaucuuagucagcgauggccgaaucugcuuccuccugguuagaaugaaugugcuaaguggauuucagauucugcucauuccguugauuacacauaa

SEQ ID NO: 3972 - RNA, 78 nt, Mus musculus
gaagcgugggaagcuagaagagggcggagccuggaggggacacccgggccgcccucucugguccuucaauuccgcccc

SEQ ID NO: 3973 - RNA, 78 nt, Mus musculus
gaugggcaggauucccugagugaacgaguugaggcggccccgacugccgcucguacucccgggggucccggagcccaa

SEQ ID NO: 3974 - RNA, 80 nt, Mus musculus
guuuauuuugggaguguuugcuguauaauuggacuugauaaaauguuuagaggugcaguaggcaugacuugaguagauaa

SEQ ID NO: 3975 - RNA, 80 nt, Mus musculus
uuuuuuuccuccuucuucuucuuccugagacauggcccgggcaguggcuccuggaagaggaacaagugugggaaaaggga

SEQ ID NO: 3976 - RNA, 80 nt, Mus musculus
caaguuagcuguucugcuccucuggagggagguuccuguuugcacaccucucuucagguagauuaaacauuuuauuugca

SEQ ID NO: 3977 - RNA, 82 nt, Mus musculus
guguuggucugcugcuggaugcguuugauggucgcucccuuggggcccaccaccagucccaccacgcgguaggguacucgua

SEQ ID NO: 3978 - RNA, 80 nt, Mus musculus
ggacauuaggagcaaccuccuaggguuguugugagaauuaaaugaacugcagcagccugaggcagggcugggcagagacc

SEQ ID NO: 3979 - RNA, 80 nt, Mus musculus; identical to SEQ ID NO: 3978

SEQ ID NO: 3980 - RNA, 90 nt, Mus musculus
cccagccccacucccccucgcugucucuugcuggcugauuuuaauucucuccuaccgggagcagcagaggaucuggagguggcuggaccc

SEQ ID NO: 3981 - RNA, 87 nt, Mus musculus
uuagucucuaggaugugcucauugcaugggcuguguagauuuuuauuuaauacacagaacaugcagugagaacuugauagagauugg

SEQ ID NO: 3982 - RNA, 109 nt, Mus musculus
guauguuuaccaugugcauguagguucagaucccuagaaaccagaguugcaaguggcugugaacugaccucuggauguuagggacugaacaugcauccucucucuacaa

SEQ ID NO: 3983 - RNA, 67 nt, Mus musculus
aggauagagcuuugcgcauuguaggcaagugcucuaccacugagcuacauugccagcucuaacccca

SEQ ID NO: 3984 - RNA, 93 nt, Mus musculus
uuagaacugggaggucuucuaggacuuuauagagcagagguuugcagccugugacacucagcucauggagaccuagguggccuuggguucuga

SEQ ID NO: 3985 - RNA, 84 nt, Mus musculus
augcccacggucaccuccauaguaccugcagcgugcuugacuuucucuauggugcaguuacuguggcuguggcuguguucgugc

SEQ ID NO: 3986 - RNA, 119 nt, Mus musculus
agccaucuccuaggccagaagcauuaacucuuugaaugcugcucgucaaagaucuguugcagagccuuugaauugaagcugcuuuaaaauuccaaugcaagggcuggugcgauggcuca

SEQ ID NO: 3987 - RNA, 90 nt, Mus musculus
gcaggcagccgguccagccuggcccugagucuccgaccccauuaacucucggguugcggacagcgcuaggucggcccugcuccccagcaa

SEQ ID NO: 3988 - RNA, 88 nt, Mus musculus
uccugaucccacagucaugguguucggucuuaguuugugaccaguuuaguuuaaccaggaccaucagugugacuauuggauugggacu

SEQ ID NO: 3989 - RNA, 83 nt, Mus musculus
cugggccuucuuucugguccccugcuucguccucuguccagauguuaagaggaugacgguggggcuggugagauggcucagcg

SEQ ID NO: 3990 - RNA, 93 nt, Mus musculus
agggggugaaggggaggccagucacacagaggacuuuagucugagaaauugaaacuaacugaccugcugugaacuggccucaugacccccuga

SEQ ID NO: 3991 - RNA, 100 nt, Mus musculus
cuggggcgcggugggacuuguaguucggucuucgcuucggacgcccaagucugcauagcgcgugguacggcugaacugcaguucccaucaugcccuggga

SEQ ID NO: 3992 - RNA, 104 nt, Mus musculus
agccaggaugcagccugcuauggaggacugagaagguggagcaguucuguaccgugcugccuuccauugguuaagaccuccaacaguaaagggcuggccggcca

SEQ ID NO: 3993 - RNA, 83 nt, Mus musculus
cagcagggugggagggagaugcugguacagaggcuugggguuuugagggcaucuuagcaguaucucccauccacccaccuggg

SEQ ID NO: 3994 - RNA, 63 nt, Mus musculus
gaagaggccuauuuaauguuagacaucuaaccucagaugucuucaucugguuggccucuugua

SEQ ID NO: 3995 - RNA, 73 nt, Mus musculus
ggcugggaagggaggaucugggcaccuggaccagcuccucccugcaggugccagcuccucccuucccagucac

SEQ ID NO: 3996 - RNA, 78 nt, Mus musculus
cugaacuccgacucccgucagcccccgagaaaaccgcaccgggucuucgcggguacugucgggacuuguaguuuagcu

SEQ ID NO: 3997 - RNA, 134 nt, Mus musculus
aacuuaaagaaaucuauagccgggcagugguggcacacacuuuuaaucccaacacuugugaggcacaggcagguggauuucugaucaaaggcaugcgccaccacucucggcuuucuccucuccuuuuuuguuaa

SEQ ID NO: 3998 - RNA, 133 nt, Mus musculus
gggauuaaaggcgugcgccaccacugcccagcuuucagagugaauuugaggcuaucuggcuauaugagacugcuucacaggguaagaaaaggggaaagugccgggcagugguggcacaugcuuuuaaucccag

SEQ ID NO: 3999 - RNA, 85 nt, Mus musculus
gaacaaggugguggaggacgagcuagcugagugcugcagacacucuaagagcacugagcuagcucucccuccaugcccugcucaa

SEQ ID NO: 4000 - RNA, 85 nt, Mus musculus
auucucaccuuacuauaugaguauucugccuaaaugugguguacggauacauuuaggcagagcacucguacaguaaggugagaau

SEQ ID NO: 4001 - RNA, 70 nt, Mus musculus
gcugguuggcauucugggccugguucaugccaccucuguuguuaacuauaccaggaugucagcauaguug

SEQ ID NO: 4002 - RNA, 74 nt, Mus musculus
gcuuuuucugcaucuaaggauauggucauuuaauuguuuuuuuccaugaucaucuccuuaaaugcagaaaaagc

SEQ ID NO: 4003 - RNA, 89 nt, Mus musculus
uggguggggguuuagaaaccaccucucuucacuuacuucugaaaguuaaaagguaguggagacugguguggcuaaaccucuugccuccc

SEQ ID NO: 4004 - RNA, 79 nt, Mus musculus
cccucucuuauugaucuccacccuccuucugugcaggcuuauuuccugcuccaagguguggaugacaaaagagauggaa

SEQ ID NO: 4005 - RNA, 89 nt, Mus musculus
ggugcugccuggucuugggaaaguucucaggcuucugagaauuugcaggagcagaaggcugugagguuccccucuuccuggcagcccua

SEQ ID NO: 4006 - RNA, 86 nt, Mus musculus
gaggucagccagaacugcagagugagacccuguuguuuguuuguuuguuugagacgggguuucucuguguagcccuggcuauccua

SEQ ID NO: 4007 - RNA, 98 nt, Mus musculus
cugguuuacuuacuacaagucccaggaugcacugcagcuuuuucuuaacuucagauaagagcauugcaugcugggacauguaguugguuuaaauagca

SEQ ID NO: 4008 - RNA, 65 nt, Mus musculus
cuucaguccagggcugagucagcggagccccgaguggcuucccuggcuggcaccuggacguaggc

SEQ ID NO: 4009 - RNA, 66 nt, Mus musculus
cuggaaaguagcucagugguagagcauaugaccagcaugugcaaggcccugaguuuauccccagca

SEQ ID NO: 4010 - RNA, 123 nt, Mus musculus
aacauauacaucuuaaguuucuuauggggcuggaauguaacucagugguauggcugcucaccaguaugugcaaggcgcugaguuccagcccuguaccaagaaaaagaaugcugaauauauguc

SEQ ID NO: 4011 - RNA, 97 nt, Mus musculus
agccuagaagagaacuuacugcuuccacuuuccuauaguuuaauuucuaacugcauucuauaggaaaguggaagcaguaaguucucuucuagguucc

SEQ ID NO: 4012 - RNA, 78 nt, Mus musculus
cagagugagcagccagugcuguuagaagagggcugagagcagggagagcucucuucugcagcacugacuuuuccucug

SEQ ID NO: 4013 - RNA, 112 nt, Mus musculus
gcuagccauaucugaaguucaacacgcccuccccucuuccuauacgucuauggaggauuuaccuccauauaccuugagagaugagguaguaguuagaacuuucauggagcaa

SEQ ID NO: 4014 - RNA, 121 nt, Mus musculus
uguggcauuugcaaacuauguagucagucaguggucccaucugucugccucucucucguucaguuuccauggagaggcuggcacugggacacaugacugaugguaugcuccccgcugcagu

SEQ ID NO: 4015 - RNA, 59 nt, Mus musculus
cugggacgagaucaugaggccuuccuggccacugggaaggacucggcccuugucccgca

SEQ ID NO: 4016 - RNA, 83 nt, Mus musculus
cuuucuugcgaagcuggagcacaaaagccggugccggugugaugccuacaccgacuucugggcuccggcuuuggaaggaagga

SEQ ID NO: 4017 - RNA, 108 nt, Mus musculus
guagaauaguguuggaagggagcuggcucaggagagaguccugagauuuaggcucuuucugacucaacucucccuuagcaagucaaguccauugaacgcuuucuucga

SEQ ID NO: 4018 - RNA, 82 nt, Mus musculus
ccugaauucuguuucuuucucucuuugcuccuuuugucugacauucaugaggauccuggggagaagaugcagaauucccugg

SEQ ID NO: 4019 - RNA, 68 nt, Mus musculus
ccuccucugcagcuguuaaggaugguggacuauuguuagggccaccaccucugcagcuguuaaggagg

SEQ ID NO: 4020 - RNA, 94 nt, Mus musculus
auagugcuagaggcugaagauggagacuuuaacaugggugcucuuaaaaucuguuaacauccaugcugccuccauuucuggucuguagacauca

SEQ ID NO: 4021 - RNA, 104 nt, Mus musculus
gaugugcauuguuggaggaaaugugucacuggggauaggcuuugagguuucagaagcucagucaggccuaguggcacucacucuuccuguugccugcagauccu

SEQ ID NO: 4022 - RNA, 106 nt, Mus musculus
gcaucauuugguaaaggcugggcugagaggacaucuuuguuccauggacccaguagauaggcagcuucugcuuccaggaacaacuugucuguuuuucagucuaucu

SEQ ID NO: 4023 - RNA, 82 nt, Mus musculus
guaaaggcugggcuuagacguggccuuuggguguggaaugcacuuccguuuguaaccgccaucuaacccuggccuuugacag

SEQ ID NO: 4024 - RNA, 74 nt, Mus musculus
guugguauugcuugggaggguccuggggaggggaguucuggcaccccaaccucucacccuauguucucccacag

SEQ ID NO: 4025 - RNA, 132 nt, Mus musculus
ccuuuacagagaaagcaugcuccaguggcgcaaucgguuagcgcgcgguacuuauacagcaguauaugugcgggugaugccgagguugugaguucgagccucaccuggagcauguuuucuucccuuuccgcc

SEQ ID NO: 4026 - RNA, 75 nt, Mus musculus
ccgcguauccagucaggagucaguuaggaaguuuuaagucugaauuaauucuggguguugacugagauguggugg

SEQ ID NO: 4027 - RNA, 66 nt, Mus musculus
guaguauaccuccuuccugcugccuuguuggcuugccggcgggagccccagggaguagagcauugc

SEQ ID NO: 4028 - RNA, 95 nt, Mus musculus
agaaggagcagagggccaggacuggcauuuggacaugcagcugcccagcaagguggugcuguccgcagcugcgcugcuccugguaacugcggcuu

SEQ ID NO: 4029 - RNA, 60 nt, Mus musculus
auauucuugaaccccugaccuccugcuuucaagugaugggguucuaagaaucugcauaau

SEQ ID NO: 4030 - RNA, 82 nt, Mus musculus
cuccucugcagcuccggcucccccuggccucccgggaacuacaagucccagggggccuggcggcgggcggagaccggaagag

SEQ ID NO: 4031 - RNA, 91 nt, Mus musculus
ugaaggugugugcauuggagcugagauucugcgggauggauuaggaguauauuguccucccacaggcccagcucauagcacaagccaucgg

SEQ ID NO: 4032 - RNA, 91 nt, Mus musculus
uccagcguuggagucagccacggcuuaccuggaagauugaaugucuacuuggcuuucuuccugucagccgugggugccucuugcuacugga

SEQ ID NO: 4033 - RNA, 81 nt, Mus musculus
ggugguacgcccuuuccucucugccccauaggguguagcucuaacuacccucuagggaagagaagguugggugaacagccu

SEQ ID NO: 4034 - RNA, 83 nt, Mus musculus
gggcguggggguggggagugcuucgugcuucugguugaagagaaaaugaccauagcacagaagcacucccaccagcuuugucu

SEQ ID NO: 4035 - RNA, 91 nt, Mus musculus
guguacuguggggcagugggccgugaaagguagccuggugguccccuuugagcuaaggcuaccuuugauaguccacugccccacggugcau

SEQ ID NO: 4036 - RNA, 105 nt, Mus musculus
gccauggugaggaagccagggagaauguaguguuaccgugagccugucagcaaauaccacucacggggacacacuuucuccuucaugggucuccccacugcaggc

SEQ ID NO: 4037 - RNA, 92 nt, Mus musculus
ggcauuugggccuggcuggagaucagguuugcacacugucuugagaacaauguuccagugaggaauccugaucucucgcccccaauugagcc

SEQ ID NO: 4038 - RNA, 67 nt, Mus musculus
ggucuggcuguuguggugugcaaaacuccguacauugcuauuuugccacacugcaacaccuuacaga

SEQ ID NO: 4039 - RNA, 87 nt, Mus musculus
gcagcugcccucuucaacaaaaucacugaugcuggagucacugugcacccacucagcaccaggauauuguuggggaggacggccugu

SEQ ID NO: 4040 - RNA, 83 nt, Mus musculus
gugugguauguuuugguugcuguagauuaaguaguuuaauaugaugcugcacuuaauagaccgcaaccugcacuggccaugcu

SEQ ID NO: 4041 - RNA, 84 nt, Mus musculus
gccccagcuuccccaguucucaggcccgcuguggugugaaguuagguucaccaagcggcugcccugggagagggggaggugugc

SEQ ID NO: 4042 - RNA, 79 nt, Mus musculus
gcgagaguaauuggaguucaugcaaguucuaaccagcuuacucaguagcugggugaauugcaguacuccaacauucugc

SEQ ID NO: 4043 - RNA, 65 nt, Mus musculus
cuuggcagucaagauauuguuuagcagacggagcgguuucuguuggacacuaaguacugccacaa

SEQ ID NO: 4044 - RNA, 89 nt, Mus musculus
gugcugagugaggcugagccccugaccuugaaccugggauccuauccaugaucuccuggugcuaccgucagggguagauuccuugucau

SEQ ID NO: 4045 - RNA, 89 nt, Mus musculus
gugcugagugaggcugagccccugaccuugaaccugggauccuccccaugaucuucuggugcuauggucagggguagauuccuugucau

SEQ ID NO: 4046 - RNA, 80 nt, Mus musculus
gaacccucugaagacucauuugagacgaugauggagcuuaagaauccaucaucaaaacaaauggaguccuccgagggcuc

SEQ ID NO: 4047 - RNA, 83 nt, Mus musculus
gggcuguugagugcgagggaccccgagggagggcaggcugccccaggcccugcccccuccaggaagccuucuugcuccagccc

SEQ ID NO: 4048 - RNA, 85 nt, Mus musculus
gcuguuccugcccaguggucacaguuggcgccagcccuagagucuagauggguugauguccacugugaccauagugcaggccagc

SEQ ID NO: 4049 - RNA, 60 nt, Mus musculus
auggucacaguggacaucaacccaucuagacucuagggcuggcgccaacugugaccacug

SEQ ID NO: 4050 - RNA, 85 nt, Mus musculus
gggcucgacuccuguuccugcugaacugagccagugugugaaaugagaacugauaucagcucaguaggcaccggagggcgggucc

SEQ ID NO: 4051 - RNA, 83 nt, Mus musculus
gggcuggacuccuguuccugcugaacugagccagugcacuggaaucaacuguuucagcucaguaggcacgggaggcggagccc

SEQ ID NO: 4052 - RNA, 85 nt, Mus musculus
ugugguuuguacugucugggagcagccaaggacaaguuaccucuugucuucuauccuuggccuuccuagguguccaagcucacag

SEQ ID NO: 4053 - RNA, 60 nt, Mus musculus
acacaggggaagcucagugccagccuuucucuuagccgcacucuggucuucccuugcaga

SEQ ID NO: 4054 - RNA, 64 nt, Mus musculus
cugcggacgggugggcgggcaggccaaauggcgcgcccgaggcugacucccugcuucuccgcag

SEQ ID NO: 4055 - RNA, 87 nt, Mus musculus
acuggcagacugccccaaagccuagacugcagcuaccuuguauugugcuugggguugcugggguagucuuuaggggaagcuguuugu

SEQ ID NO: 4056 - RNA, 90 nt, Mus musculus
gccaagcuaaggacuuugaucugaugagcuaagcuggaguucccauucaccuggcuccaggcucaucagaugaaaguccuuagcuuaggu

SEQ ID NO: 4057 - RNA, 79 nt, Mus musculus
gguuugagaucugaagcgccuguucuuggaucguggcccuguagucauccucgggcaaagcgcuugacaucucugugcc

SEQ ID NO: 4058 - RNA, 84 nt, Mus musculus
cugggcuggggcucagacuggagcuuggagcggugagcuggacucgggcuugcgcuccgaucucugagcugggcucuugcccgg

SEQ ID NO: 4059 - RNA, 64 nt, Mus musculus
ggacagagugugugugucuguguggagacaggaguugcccacacauggcacucaacucugcagg

SEQ ID NO: 4060 - RNA, 64 nt, Mus musculus
aguaaaggcugggaauauuucagagauauauauguauaucuccgaaacauucccagccuuuacu

SEQ ID NO: 4061 - RNA, 69 nt, Mus musculus
caaauaguugaagguuaauuagcagaguaacugaauauaguaauucugccagucuccuucagacaaaaa

SEQ ID NO: 4062 - RNA, 69 nt, Mus musculus; identical to SEQ ID NO: 4061

SEQ ID NO: 4063 - RNA, 89 nt, Mus musculus
gucccaacucugggaaggugccauuccgagggccaagagucugaauaugagucacucuggcugcuauggcccccucccagggcuugggc

SEQ ID NO: 4064 - RNA, 87 nt, Mus musculus
cugccauccuacacuuagauuguaggcccauuggaaggguuagcgucuugaccccaaugagccuacagucuaagugugggauggcgg

SEQ ID NO: 4065 - RNA, 56 nt, Mus musculus
acagggcagggcaagaguugagacuuauggcuccuaacucacugucauguccucag

SEQ ID NO: 4066 - RNA, 74 nt, Mus musculus
cagugccugcuaugcaguuguucaugagcucuggcuccgaagguucaugagcagcugcaaagguguugcugcug

SEQ ID NO: 4067 - RNA, 84 nt, Mus musculus
guggcuugcaacugaguucagggacagcgugucucaguuucucugucugagcaucugcugauccugagcuguguuuuuagcugc

SEQ ID NO: 4068 - RNA, 87 nt, Mus musculus
uuccugucccaguggucuggguggggccugagauccugaauuucuaaugagcucccaggugacacccugacucacugugccagagga

SEQ ID NO: 4069 - RNA, 76 nt, Mus musculus
ugcuugcgggccaugggucugguugggcccgcagacucggagugcgggccugaccagucucaagaccugcguggua

SEQ ID NO: 4070 - RNA, 96 nt, Mus musculus
uaagaggcuggaccugaggggaaaaugccuuucucccaguuuccugaucuuugugucugggaauggggcuguuuccccuccuguccugcaaucuua

SEQ ID NO: 4071 - RNA, 87 nt, Mus musculus
cgagcucggcucugccgcaccccgcggagcucacacucgaccuuccagagaaggguguggacaccgugggagguuggggaggccucg

SEQ ID NO: 4072 - RNA, 64 nt, Mus musculus
uuguuggggacauuuuuaaagcauggauugguuauugauuuguccuuuaaauuguguccucaag

SEQ ID NO: 4073 - RNA, 87 nt, Mus musculus
gagcccugugcacaagcuuucucaucugugacacucgagaugguuucagggaguggacacuggagagagagcuuuugcaagucgcuc

SEQ ID NO: 4074 - RNA, 67 nt, Mus musculus
acacaggugggaaguguguguccagugggugugucuacagaucugcucagaccuuucuaccugucag

SEQ ID NO: 4075 - RNA, 87 nt, Mus musculus
ugugguugggaggaguccuaacagcaggaguaggagcucugauuauccccugcuucugcugccugccuuuaggacccuuuccccaca

SEQ ID NO: 4076 - RNA, 84 nt, Mus musculus
aucgauccccaucccagcuuccuuccagcccuugauguuuuaguacgcacauaggcuagagagagguuggggauggggaaagau

SEQ ID NO: 4077 - RNA, 65 nt, Mus musculus
uugggaacggggugucuuugggagucuugggggcuaccaaaccccugugacacacccgcucccag

SEQ ID NO: 4078 - RNA, 88 nt, Mus musculus
gugggguagguagcagguaccauugacuaaagcuaguacuauaggcuugccucuagcuuugguggauggucuuugcuaaguucucugc

SEQ ID NO: 4079 - RNA, 104 nt, Mus musculus
gugaguggccaggguggggcuggguggugcaggcaggagagccauugaucuauugugggcucuacucccugccccagccagagcaccccauuggcuacccacag

SEQ ID NO: 4080 - RNA, 67 nt, Mus musculus
aggagggaggaucugcuguuagaaagucucugguuugugaccucuaaccucugauccuucccacagg

SEQ ID NO: 4081 - RNA, 63 nt, Mus musculus
cuagggggcaggagccggagcccucugcugaacugacagacgcucugcuuugcucccccagau

SEQ ID NO: 4082 - RNA, 85 nt, Mus musculus
gagcaggcucuggagagcaagcccguaagcagcguaaguuacugaggaacacugcuuaugagcuugcacuccauagccucugcuu

SEQ ID NO: 4083 - RNA, 82 nt, Mus musculus
agggaagcacagguggcucauuuagaagcagccauacacucagagaguggcugccuauacaugggcuuuccugugcuccucu

SEQ ID NO: 4084 - RNA, 90 nt, Mus musculus
cccacccugacgcauccuguacugagcugccccgagcugagcacagugaaggaccucggggcagcucaguacaggaccccucagggaggg

SEQ ID NO: 4085 - RNA, 79 nt, Mus musculus
cacaaccagggucucuaaagcuagacguuccggagaauuuuuuuauuucggcgucuaggucuagagucucaaggaagug

SEQ ID NO: 4086 - RNA, 88 nt, Mus musculus
ugccugcuccuguaaauggaugcgaugguucccaugcuguucugaggcagagcuagggccaucucauccagauacuguggagauggua

SEQ ID NO: 4087 - RNA, 80 nt, Mus musculus
uguggggcuguguucugccuccccugaaggcucuguugucacucugggcacuccaucggaggcagacacucaaccccaca

SEQ ID NO: 4088 - RNA, 82 nt, Mus musculus
cuaaaugaacagugacauagaaaaggcagucugcauuuauucuggagcugcaguuugucucuucuuugucucugucaguugg

SEQ ID NO: 4089 - RNA, 76 nt, Mus musculus
ggcccuggcccggguccuggcccugguccggguccuggcccugguccuggcccugguccugguccuggcccuggcc

SEQ ID NO: 4090 - RNA, 77 nt, Mus musculus
ccuggacucacuuuguagaccaggcuggccuuaaauucacagagaucagccugccucugccuccugagugcugggau

SEQ ID NO: 4091 - RNA, 126 nt, Mus musculus
ggauucucuguguagccuuggcuguccuggcacucacucuguagaccaggcuggccuugaacucaaaaauucaccugccucugccucccgagugcugggacuaaaggcaugcgcuaccaaugcccg

SEQ ID NO: 4092 - RNA, 131 nt, Mus musculus
aaaggagcuucaguugagccuccaugagauccaacuguaaggcauuuccucaauuagugcuguuaugcugcuaguguaugcucuguccaguuucuuuuuggagguauuuagagcuaugaguuuuccuuuua

SEQ ID NO: 4093 - RNA, 102 nt, Mus musculus
agaaaugccuccaugagauccaacuguaaggcauuuucccaauuagugauaaaggggaaaaggccccuugugggugggacaaucucugggcugguagucuug

SEQ ID NO: 4094 - RNA, 71 nt, Mus musculus
uucuuuccagcuucuggcuauuauaaauaaggcugcuccuuauuuauaauagccagaagcuggaaggaacc

SEQ ID NO: 4095 - RNA, 78 nt, Mus musculus
ccuguugagccaucucaccagcccagaaaauauuuuuaaaaagugaauugucuuaagcuggagagauggcucagcagu

SEQ ID NO: 4096 - RNA, 55 nt, Mus musculus
cugagccaucucuccagcccaagauuagguuuuaagggcuggagagauggcucag

SEQ ID NO: 4097 - RNA, 81 nt, Mus musculus
cugcugagccaucucuccagcccccauaauaagucuuuuaaauguaaaauucauuauaggaguuggggagauggcucagua

SEQ ID NO: 4098 - RNA, 81 nt, Mus musculus
ugugcuuaaccacugagccacuuuccagcccuuugaaaacuuauuugagggcuggagagguggcucaguggcuaagagcac

SEQ ID NO: 4099 - RNA, 110 nt, Mus musculus
cucugccuucaagagacugacacugggcuggagagauggcucguaaggaagaacacuggaugcuuucucagaggacccaaggucaauuuccaguacccacaaggcagaca

SEQ ID NO: 4100 - RNA, 136 nt, Mus musculus
ucugcuagagcagcauaugccccaaccacugagccaucucuccagccccuuuguuguuuucaauacauaaaauaagcaaauaggacuggagagauggcucagcgguuaagagcacugacugcucuuccagaggucu

SEQ ID NO: 4101 - RNA, 136 nt, Mus musculus
cucugcaaguggagcaagugcucaccaccgagccaucucuccaaccuucauauuuguauuuguuagacaagaaguacaaaagugaggcuggggagaggguuugcaguguguauugcucuucuaaaggaccacaguu

SEQ ID NO: 4102 - RNA, 58 nt, Mus musculus
cccugggaggagacguggauucuuuagagugcaucugcgucuuguuccagguucagcu

SEQ ID NO: 4103 - RNA, 65 nt, Mus musculus
caaaucauguacccccacagaggguccagaugguucuuaguucuucuggaggcacaugguuugaa

SEQ ID NO: 4104 - RNA, 147 nt, Mus musculus
uuuggggcugucuuuauguuguugcugagaaaaugacaacuggauaugaugacugauuaccugagaaauaauugaugaaaucucaagaaaauuccucuagauagucaaguucugauccagcuaugucaacucaaagcagcaaccuug

SEQ ID NO: 4105 - RNA, 61 nt, Mus musculus
agaaaggcaucauauaggagcugaauggcugugcaaucaacuccugcaugacgccguuccc

SEQ ID NO: 4106 - RNA, 88 nt, Mus musculus
gugggaagagggguggggcccgggacuguacccaugugaggacuauucuugaguccugcucuuguucugagcaccaccccucucucag

SEQ ID NO: 4107 - RNA, 58 nt, Mus musculus
ucggaggagagcagaccgguggucgaaauccggaccucagucugcgcuccucuccagc

SEQ ID NO: 4108 - RNA, 86 nt, Mus musculus
gaccaguuuggggaacagggcaagguggacaguagcugacagccuguuuacacuuguccuucuuuccccaggcuauaguucgguug

SEQ ID NO: 4109 - RNA, 61 nt, Mus musculus
cugugggcugggcugggaagcagcuuucaucccagccuccugcucagccccgcccacccca

SEQ ID NO: 4110 - RNA, 73 nt, Mus musculus
gccacggcuuccugcgcccccgaucggggccgccaacagcgcuggcggcggcggcggaggcgggggcaguggc

SEQ ID NO: 4111 - RNA, 59 nt, Mus musculus
agaggaccaaaugcacucagagcaguugaguaucagcugcccucagcucaguuggacaa

SEQ ID NO: 4112 - RNA, 64 nt, Mus musculus
uggguugagaaauguacucugccacguaggagcuagguaguaguuuguacauuucuuacucccu

SEQ ID NO: 4113 - RNA, 71 nt, Mus musculus
ugggauguaucccacuucugacacuggugauauuguuuaauaucuuacagguuuuagguggaauauuuucc

SEQ ID NO: 4114 - RNA, 74 nt, Mus musculus
gggccugcuuuccaaguuauguagcuagcaaggagaacucacagcuucauaagguagaaagcacuaaaugggcc

SEQ ID NO: 4115 - RNA, 69 nt, Mus musculus
gggaagucagagagcugcagcugagugcacagaaggcugcugcuuaucagccugauguucaaggcuugc

SEQ ID NO: 4116 - RNA, 85 nt, Mus musculus
aacacaggaaaagacagcugccagcuguagaacuguuuuuaauuaaaacuguguucaucaugcuugcugcagaguuuucuuauuu

SEQ ID NO: 4117 - RNA, 68 nt, Mus musculus
acuggcugcaccugacucaggcagcaagaauucuauugagcuugucugacugauguuggagcacaaau

SEQ ID NO: 4118 - RNA, 100 nt, Mus musculus
acgccgagcguguggugguaggauccguguagcaccgucuguguguuguugugccacacagagaacuugagcgaaucccacuccagacaccaugaguagg

SEQ ID NO: 4119 - RNA, 92 nt, Mus musculus
aaauggauuuccccuaaaguagaaaucacuauagaguugcaugguuacagaggacuagaauuuagauuagcuacuuacagggcuucagaucu

SEQ ID NO: 4120 - RNA, 90 nt, Mus musculus
cuaggaauuugagguuguaguuugugcuuucuaucuuguagagauuucaauacucaguaugaagcagaaaccagcaucacccuuuuguuu

SEQ ID NO: 4121 - RNA, 83 nt, Mus musculus
aucugggcuuggcagguggaaugggagguggcagggagaaggcaguuuucccuccccaccccuguaccagugaagcggaaagg

SEQ ID NO: 4122 - RNA, 59 nt, Mus musculus
uccuagcucccgccacugugacccccuuaccuuuaggagcuccgauccgggagccuggu

SEQ ID NO: 4123 - RNA, 82 nt, Mus musculus
auuagccagaguuacauggugaagcccaguuuuguuuuguuuuguuuuugagacaggguuucucuguguagcccuggcuguc

SEQ ID NO: 4124 - RNA, 74 nt, Mus musculus
agaauucaguuagaaauuacauugauuuaagaagugguaaugggcuuagaucgauguggugcuccugaguucuc

SEQ ID NO: 4125 - RNA, 64 nt, Mus musculus
gugggagggaggacuugggaacugaagagcagaguucgaaucccagcggugccucuucccgacu

SEQ ID NO: 4126 - RNA, 83 nt, Mus musculus
auuuucuuaguaucaguuacaaacaaaaaccguuuuguaagacuuguuguuuuuguuuguuuugcugaugcagccagagaaug

SEQ ID NO: 4127 - RNA, 79 nt, Mus musculus
cuucugguggucuuuggggacccuaggaucugggcauaacauuugggggcucauccgggauccccugaggcccccagga

SEQ ID NO: 4128 - RNA, 94 nt, Mus musculus
gcucuuaaauguugaggcaucucucuagcuccagagagcacgguuuuauaaccaauuguucugugcuagugagguggcucagcaaggaagggca

SEQ ID NO: 4129 - RNA, 73 nt, Mus musculus
cacucgagcaacaacaacagcaacaacccgagagccuaucuagggccuaggucuguagcucaguuggcagagu

SEQ ID NO: 4130 - RNA, 88 nt, Mus musculus
uccaagauguugggcagaggaggcagggacaacaaacugguggcccagcuguaucaaccugugcuucucuucccagucacccugugaa

SEQ ID NO: 4131 - RNA, 85 nt, Mus musculus
cagugaagcuuccacuguucuuaccauucccucuguggccucgggggacccaauggugguagagcacuggaugguuucucaauga

SEQ ID NO: 4132 - RNA, 87 nt, Mus musculus
agcggaggagguagagggugguggaauuugaugucaucucugccacuacuggacagggcuacguuguucuagccacuugcccugagu

SEQ ID NO: 4133 - RNA, 60 nt, Mus musculus
ggcugggguguagcucagcgggagagcaccugcuucauccccagcuacauuuccagugcc

SEQ ID NO: 4134 - RNA, 82 nt, Mus musculus
uagggaugggacagaggaggagagagauccuguuuaacucacugcaacaccagggucacucccuccucucugcucucccugg

SEQ ID NO: 4135 - RNA, 61 nt, Mus musculus
acuggagacggaagcugcaagagcggcugaguguggggucuugcaguuccuguuccagaag

SEQ ID NO: 4136 - RNA, 63 nt, Mus musculus
auuuugauaggaaccccgccugaugcuuuuugguuuguuucaggcagggucuucauaucgaga

SEQ ID NO: 4137 - RNA, 67 nt, Mus musculus
cuuaggaggcagagguuggcugaucucugcuugaguucgaagguuaggccagccuggucuccaaaga

SEQ ID NO: 4138 - RNA, 57 nt, Mus musculus
cagggcuggccuaugggacagauacuauaagucaucucauccuggggcugggucugc

SEQ ID NO: 4139 - RNA, 78 nt, Mus musculus
gagcugguccuuuggggcuguggugccaccagcugugacagaguggagcucaguggcagcagccccuucagacaggcu

SEQ ID NO: 4140 - RNA, 74 nt, Mus musculus
ggugaguuggugauguggugacauguaggacaggguaggcucuggcagcuugugaugagacaucucccacucau

SEQ ID NO: 4141 - RNA, 89 nt, Mus musculus
guccgcuaccgcgggacccggggcugugucaggucuggaaguggagcuggagcugaccgaaggagcugccgcugggccgggguggaaca

SEQ ID NO: 4142 - RNA, 83 nt, Mus musculus
cauaugccaugguguguagauccauaugccaugguguguagacccauaugccaugguguguagauccauaugccauggugugu

SEQ ID NO: 4143 - RNA, 72 nt, Mus musculus
uagaaagguggguccagugacuaagagcauuugagcacuuguucuugcagaggacccaaguucaauuucuag

SEQ ID NO: 4144 - RNA, 85 nt, Mus musculus
aaggauggcucagugacuaagaagcacauacugaucuugcagaagacucagguucaguugucagcauacucauuggguaguucua

SEQ ID NO: 4145 - RNA, 79 nt, Mus musculus
cgccuugcagucuaaggagagccccaugccuuuggacaugcuguuccuucugccugggauuuccuugucugccugguga

SEQ ID NO: 4146 - RNA, 77 nt, Mus musculus
gggaccggacgccuccugcagcugcgggagcccgugguuccccgggcaaccgcgggcggggccgggggcggggccca

SEQ ID NO: 4147 - RNA, 71 nt, Mus musculus
gcuuucucuacuuggugaaauguggugacauauggugacauuucucccaacccuuuucccaggagagaggg

SEQ ID NO: 4148 - RNA, 84 nt, Mus musculus
ucuuaauuacugaggucuuucuagcuccuguuuuacuaauuuaaaaagugcaauuggggcuggcgagauggcuuagugguuaag

SEQ ID NO: 4149 - RNA, 78 nt, Mus musculus
ucaccugaauaugugggggcauugguauuuucaaagcagcauuuugaaugugccugugcaucucuucccacaguggug

SEQ ID NO: 4150 - RNA, 84 nt, Mus musculus
ccuggagcgcgcgggcgaggcaggcgcagcgcaccggggcucucgugggcgcacugcugcgcgcucgcaccgcgcggcucucag

SEQ ID NO: 4151 - RNA, 93 nt, Mus musculus
ggcggcggcgucggaugcgcguguggcggaagcgccggcggcaugaacuacccgggccgcggcgccccacggagccccgagcguaacggccgc

SEQ ID NO: 4152 - RNA, 71 nt, Mus musculus
caggccggcguggggugguggacucaggcuucuggagcugaagccugauguuccccaucccgcagcggccu

SEQ ID NO: 4153 - RNA, 77 nt, Mus musculus
cgccgagaggcuggagcugcggcagcgcaggccugggccgccgugucucugccgcucgcuucaguuuuccucagggc

SEQ ID NO: 4154 - RNA, 78 nt, Mus musculus
ugaacagacuuggcagaaagggcagcugugaugcuuguccuaguuuucacggguggcccucuuucugcagguacauuc

SEQ ID NO: 4155 - RNA, 79 nt, Mus musculus
gagaggacucggagcccagccaccuagacuuucccaggagaagcgcaggucuagguggcaagggcguccugguccuacu

SEQ ID NO: 4156 - RNA, 76 nt, Mus musculus
gggccuuuccaagggugguuuucacgugagucuugauuuugucuuuauaugcgagggaacuacugggaacugggcc

SEQ ID NO: 4157 - RNA, 60 nt, Mus musculus
cuugguuguuuucugagacagaaaagagucucauuuucugucucagaaaacaaccaagga

SEQ ID NO: 4158 - RNA, 60 nt, Mus musculus
cuugguuguuuucugagacagaaaaugagacucuuuucugucucagaaaacaaccaagga

SEQ ID NO: 4159 - RNA, 60 nt, Mus musculus
uuuccucucaucacaaguugagaauacacagacagaucaacuugugaugaggugagacag

SEQ ID NO: 4160 - RNA, 57 nt, Mus musculus
guaagugagggcaagccuucuggguuccuaccaucccaggcggccucagcucucacu

SEQ ID NO: 4161 - RNA, 51 nt, Mus musculus
uacccuuuacaccguguagugaccugaaacacacuauaccauguaaagggu

SEQ ID NO: 4162 - RNA, 61 nt, Mus musculus
agucacuaauggcauuuuuguugguuguuaccagaacaacgaaaagcucauuggugauuuc

SEQ ID NO: 4163 - RNA, 56 nt, Mus musculus
acgaggcaggggcuuugacugugacaaaaucacucacagucaucccccugccucac

SEQ ID NO: 4164 - RNA, 63 nt, Mus musculus
aggagguccuggggccgcccugaaggcagaacaugagaauucugggcccuccagaccucaugc

SEQ ID NO: 4165 - RNA, 60 nt, Mus musculus
uucaccacacccagcuuaaagaaaguuuaaaaaauauucuuagcuggguagugguggugc

SEQ ID NO: 4166 - RNA, 70 nt, Mus musculus
uggcagcuggcaagucagaaugcaggugugaauggacaugggggucugguucuggcuuucagcugucacc

SEQ ID NO: 4167 - RNA, 61 nt, Mus musculus
uauuguaaacucugccuuaauuuaguuagguuauucuaauuaaggcagaguuuacaauagg

SEQ ID NO: 4168 - RNA, 80 nt, Mus musculus
cccggaaguucuugaguaggagacuccacaucccgggugacccggguuggagcugcugauucaaguggucucucgugucc

SEQ ID NO: 4169 - RNA, 60 nt, Mus musculus
gccccaucgauuaacugcuuccuguucucaugacccggcagcaguugagugaugugacac

SEQ ID NO: 4170 - RNA, 61 nt, Mus musculus
agagggugcgccgggcccugcguccccgcccuagaggacagggcucuccggcgccccucgu

SEQ ID NO: 4171 - RNA, 89 nt, Mus musculus
aaguugauaggccggcaauacgcacacuuaagacuuuagaagcucucagacuaaagucuuaaggguguguauugcaggccuagcaaugc

SEQ ID NO: 4172 - RNA, 69 nt, Mus musculus
agagucuugggacauaguguaaggcaguggucuggcuagucccacuaacuggcucuuugucccucggca

SEQ ID NO: 4173 - RNA, 123 nt, Mus musculus
acaacucaccugccgaaucaacuagcccugaaaauggauggcgcuggagcguggggaccauacccagccgucgccggcagucagggguggggguggggguggagaaagaaaaaaaaucaauaa

SEQ ID NO: 4174 - RNA, 91 nt, Mus musculus
aaaacagugucuucaaugugggacaggacucaacacucaaguuacccuuuaacuuaaggauugggucuuggaauucauguauugagauauc

SEQ ID NO: 4175 - RNA, 129 nt, Mus musculus
cugaaccccuuaagcacucaaguuauugcccuccuaucugaccugagugaacuaggcuauuucuaaagaccuuuauuagucaguggaggaaaugaagggagccaagccaggugugaaaauauucccgau

SEQ ID NO: 4176 - RNA, 105 nt, Mus musculus
uaaagcggugauguuucuggcccuggguguuagcguuggaucacucaguguugugggugcuagcguuggaucacucggugcuguggcuuccaugguuccgaacag

SEQ ID NO: 4177 - RNA, 117 nt, Mus musculus
uugagaaaaacaaaaccaaaaaaccccaaagcaucgcgaaggcccacggcggguguugacucgaugugauuucugcccagugcucugaaggucaaugugaagaaaugugacucucuu

SEQ ID NO: 4178 - RNA, 103 nt, Mus musculus
caggaaccucagucauuauaacacucacggcggcuggaauucccaucaagugaucugugagggaauuuccagguggccaugacgugacagagcagaaugacgg

SEQ ID NO: 4179 - RNA, 117 nt, Mus musculus
aggcucuggaaggugaucgacucauagcaugggggcguggaauuaucggguaaggaguacgucugccgauagccauaugcuuccagcccauagcuuggccuaccccagcuuccuagg

SEQ ID NO: 4180 - RNA, 98 nt, Mus musculus
aucugcauacacagugauauucugcauggacaguguaggcauuucuaacaagaacacugaugcuaauuaacugaguguagaaugaguuacaugaggac

SEQ ID NO: 4181 - RNA, 130 nt, Mus musculus
uuccuucucaugaaagacacuuguguaagcauuucucggauuuaguaagagaucuuuuauguaugagucugaguaucuuuuauaggucugauggaaaauguaaaauugagggcuuacauggauuaaggau

SEQ ID NO: 4182 - RNA, 105 nt, Mus musculus
ucuaacauuucacaguccuuuucuauccaagaagagguguagggggaggaacacccuguaaacaaugucacucuguggagaugagggcugcuggguugcuagguu

SEQ ID NO: 4183 - RNA, 109 nt, Mus musculus
uccaguauccugguuucucucauuugugcuuacugaguuuuauauagucacauaaaaccauauguguacauguuaaaugaaaguagaagggagaauguaugaugcaggg

SEQ ID NO: 4184 - RNA, 117 nt, Mus musculus
ggcaguagaugucugaggaugccuuuguccucaguguuaggcugagaaaggagcuggcagggcaccaucacugcaggccuaaagcuugggaagcuggucuccuacacacauuugugu

SEQ ID NO: 4185 - RNA, 119 nt, Mus musculus
cuucuuccucaaggucaggcccugggucgucagcagcagcuucgcuuuggcuccgauggcugucuucggaguuugaagcccuugccgccagacgcuggguuggcaucaguggauggaau

SEQ ID NO: 4186 - RNA, 121 nt, Mus musculus
uuuucaacauauccaaaaauugaaggagcccagugcaaugauauugucacuauauggcugauaggcuuccucaggagauaguauaacacugagggucaacugaauuuugugugucuggagc

SEQ ID NO: 4187 - RNA, 125 nt, Mus musculus
cuucgauggagccugaguggacagaucuccagagaggauccgcuaucaugcaacuguggcaagucagcagcaaucuggucuuugaggauucuuuuaaauggucugcagacacaguuccuuugaga

SEQ ID NO: 4188 - RNA, 84 nt, Mus musculus
uucagauagcuauuuauugcagaaaaguggggcagccuggcauuauguucuccacuucuauguaaaguaggagcugacugacac

SEQ ID NO: 4189 - RNA, 104 nt, Mus musculus
uuuuccuacuguuuuccuacuguuucccuuuuagguuuugaauugucuguguugagcucauuugugguggcauccagaguggagaugggagaacaggaggaagc

SEQ ID NO: 4190 - RNA, 128 nt, Mus musculus
gcuuugugaguuuuccuuguuucaguguuagucuagcacugcucagggugaacuaguacagugugugguaguacuagguucuccauggacacaggcauaaaugaaacuugguuucugcucuuaaagcc

SEQ ID NO: 4191 - RNA, 81 nt, Mus musculus
guggcagggcagaugacccaaguccagaucguuggaaccuauauaaagccagauacgauagcaggugucugcaaugccaaa

SEQ ID NO: 4192 - RNA, 101 nt, Mus musculus
cagugcggcuggcuggagaugcuugggcuagggcuccgccccagaaguucugaaucaggaauucaguggcugagcccccugcagucuuucacaagcucacu

SEQ ID NO: 4193 - RNA, 120 nt, Mus musculus
ggcacaaaaggaaaggugguuuguacauucuaguccugggcuuuggguagaaggaacaggccacccgaugguagcggaggaacuagauguacuucacucagccuuuauaaggugugugua

SEQ ID NO: 4194 - RNA, 97 nt, Mus musculus
gcucugagaauucuuuaaucccucccacccacagaguaagcuaacagccuccgcuguaaccuguggaaugugggaggggcaugcggaaugugggagg

SEQ ID NO: 4195 - RNA, 105 nt, Mus musculus
ccaauguauagcaggugcauuauaaauauugguugagcaugugauugauacacaguguauacuaccauauacuuaucauauuuucaugccuugagcacacguugc

SEQ ID NO: 4196 - RNA, 99 nt, Mus musculus
uagcguugcucagggagcacauguaggaaagcugaaauggaggacggaacacuuuggacuuugcucaguuugcuuugcagagauccucugggcaugcuc

SEQ ID NO: 4197 - RNA, 116 nt, Mus musculus
ucauuucauuuugaccuuugggaaaaggaccccagcucuggugaauccugagacuuguccuuagugacagcuccaguguggaaucuugcuguuccuucugaggugggaggagaugg

SEQ ID NO: 4198 - RNA, 113 nt, Mus musculus
gucuagaccuaguuagcagcacguauuuauccuauuaaggguagggauuagaaugaaaauguaauguuuacccuggagagagccaggagugugugucugguagaaguuuggag

SEQ ID NO: 4199 - RNA, 116 nt, Mus musculus
ucucuugcagagcccagaguaucugacuugcccuggggaucaggucucugucuuuggagcuccaggguugagagacugcaaccaggaagucuuacuuguugggguuuugugugggu

SEQ ID NO: 4200 - RNA, 106 nt, Mus musculus
agcuaugcugugacaucacaaugcuccaaugugauaucacaacuccauauugugccaacacagugcuguacuguuuuauuaugaugcugauugugccagcauagug

SEQ ID NO: 4201 - RNA, 102 nt, Mus musculus
cuccccagaguccuaacaaugacuuauauaauggcaguucagcacugagaccuuaugcaugaagaggcagccugugugugacagcagggcacugugcaggaa

SEQ ID NO: 4202 - RNA, 104 nt, Mus musculus
guacuuacaaaggcgcgcuugucgguguaggcagggguugagagggacguuagguagcaguccauaggcccuuucuuagcacugcucagggcuuucagguugca

SEQ ID NO: 4203 - RNA, 101 nt, Mus musculus
cccaguguggcaguauacagcuauaauuccacugaggugauauacacccauaaucccagugugguggcaugucccuaugugaugguuuguauauccuugga

SEQ ID NO: 4204 - RNA, 81 nt, Mus musculus
acugauuguggcggagagaugguucuggcggggcucaucaggaagcucgguaacugucgauguugcccagggucagaagag

SEQ ID NO: 4205 - RNA, 126 nt, Mus musculus
gcaucugggaggguggucauagguuaaccuuaguguugcucaggcagcaggagagugugcaugugugcaggguaggccugcaucugggggucauaggucaacuuuagaaaguguuccucagaagcu

SEQ ID NO: 4206 - RNA, 101 nt, Mus musculus
acauggggcugaauacuguugggugaggagcuccucugacaagggcuguacuucccaccacuuccuggagagcugccuggcucagcagucacccugugacu

SEQ ID NO: 4207 - RNA, 107 nt, Mus musculus
auucauucuuuugcuggugggcaucuaggcuaguucuguucuugggcugugauggacaggacaacaacaagcaggguguggagaguccuucugugauggauauggag

SEQ ID NO: 4208 - RNA, 114 nt, Mus musculus
caggcuuuacuuuuucaaucuuucgagauaaaauuccucuacgugguccugugauuguccucugacgcacucuguagacuggacuguccucaaaauuggagaacuaccugccuc

SEQ ID NO: 4209 - RNA, 86 nt, Mus musculus
cuauagggcuggggaauagcuuagucagcaaagagcuuguuucacaagcaugaggacaugaguucgauccccagcacuccugugaa

SEQ ID NO: 4210 - RNA, 101 nt, Mus musculus
ucuguucuugagggauuccgauucuaauaguagaagaccuggguuagaaaucuggcuuagccuuuaauauauuuguugggguuugcugcauaagagacagu

SEQ ID NO: 4211 - RNA, 82 nt, Mus musculus
acucuggcaagugggucuccuggggaggaaagaugcugagccuaucagucauucucagcuaaggggcccggggagccagagg

SEQ ID NO: 4212 - RNA, 102 nt, Mus musculus
aucccagccgugugggaaguagaagcaagaacaggaguucaaaggcagcuugggcucccugagacccugguucaggaauuuauaacgguccacuggggggaa

SEQ ID NO: 4213 - RNA, 93 nt, Mus musculus
gaggaauguccagcacgucuucacucuguuauuuccuagacagggcaugaaccuccucugggaagcaguggaggggagcagcuggcagcuccu

SEQ ID NO: 4214 - RNA, 106 nt, Mus musculus
aggucaguuggcucaguucaguguuggugagugucuagacacagguuaaaaauagcagauucgugucucuaguugcauauguagcagaggauagccuaguuggcca

SEQ ID NO: 4215 - RNA, 120 nt, Mus musculus
ucucuucauauguuggcugcugaugucuuguauggauguuaugauucucuaagacuugggagcaauguagcagauggacauagagaugcaaccaaggcaggaacagcaaaggggaagagu

SEQ ID NO: 4216 - RNA, 111 nt, Mus musculus
agaugggaacucauuguacauuuuugaaguaguuugucaugcuggagguucauuuaggcaguucaaguggcuugaagcucuucugggaaguucaguugaucucuccuauca

SEQ ID NO: 4217 - RNA, 109 nt, Mus musculus
cucacuaccucuuugaaaagaacuggggaaacuuccagccuucuauccaggcaguuuuggguuuaagcaugcugguuuucuauguccaucccuuuauugaaggagugaa

SEQ ID NO: 4218 - RNA, 102 nt, Mus musculus
aggugggugacuuucauuucugcuuucuaauacucauuuuucauucauuuuccuguggcuuuaugggaauaucuaggaggugaagauugaggccacccucca

SEQ ID NO: 4219 - RNA, 107 nt, Mus musculus
guccaacccaggcuacguaagaaguuauaagcuaguuggugcuacagagaaagacuuucucuuaaaaaguaaaaacuauuaugguuuucuuagguguuugaaugggg

SEQ ID NO: 4220 - RNA, 95 nt, Mus musculus
ggcaugugugaauuggcugacuguauuccaaaguggggcuucgacauaaagauuuaagcauuuccaaguuaaaugauaccagcuaccacagugua

SEQ ID NO: 4221 - RNA, 131 nt, Mus musculus
uagcccaguguucuccaguccaugacuuccucacaguguggccaauuggagauuaugaaccaugacugcucgcccaucacaguuucuaaugcucagcacguguggcacagauuuaaggaauacaaaggcuc

SEQ ID NO: 4222 - RNA, 114 nt, Mus musculus
cguugcacauagaagagaaaccugaaguacuugucuuugugagucugguuuauuuuuucuuaacauaauaauauucagagggucgacacuucauuugucuucgugucugcauca

SEQ ID NO: 4223 - RNA, 107 nt, Mus musculus
ucucgcaugguucacgggaggacacacgcguuucuguuggugauuggggagccugccuuuguucccacauuguaaggaacugccugauuuucucugaaauauggagu

SEQ ID NO: 4224 - RNA, 115 nt, Mus musculus
ccagcaaacaguugguugagucaggucaaggucuagcagugaaagcuuugggaaaaugucuucccuggaguuuuacagcuagauaagucaggcacccucagauacucuuugguga

SEQ ID NO: 4225 - RNA, 81 nt, Mus musculus
agcuucuggugguuguaagcaacuauguggauacugggaaucagaccuggguccucuguaagugcuuuuaacugcugagcc

SEQ ID NO: 4226 - RNA, 87 nt, Mus musculus
ucaggaugcuggugacaugagugaacagaaggaaccaagcacagauuuguugguggcacucaccuguccucuucccagcuagcuugu

SEQ ID NO: 4227 - RNA, 110 nt, Mus musculus
accacuugguucucugucacauauucuaaucauaugguuuugugucacagaaauaaaagcugagacuugcaagcugcauuuuuuggaauguaaagagagcacacaaggga

SEQ ID NO: 4228 - RNA, 116 nt, Mus musculus
cagcauguggaacacuguaaagugcugugucacggacacugacuuuucaaaguccaguaagucagucugcuuagaggucagugggcaauacuaugcuauguucuggccccauguuu

SEQ ID NO: 4229 - RNA, 61 nt, Mus musculus
cagggcagcuuuccuacuguuucccuguaaucucagugagccacguggggagauggaacuu

SEQ ID NO: 4230 - RNA, 105 nt, Mus musculus
ccagggcaaggaugacagagaggaagacuaggggcuuccaggacaaggagucgcaacucucuguaaccuggguucugcagguuuccucauguaucugggcccugu

SEQ ID NO: 4231 - RNA, 104 nt, Mus musculus
ucagcaugccuuagggugggaugcaagucuuuagacaagagugguuuagggcuaaggccuuauuuuugagacagggauucucacuugcugaugcagcaaggcug

SEQ ID NO: 4232 - RNA, 108 nt, Mus musculus
agaaugacacuccagguggaauggcuucccuuguguauccgguggccucagugagucagaggugugcccacaaugccggaggcuccauugcaguggguguguuacuca

SEQ ID NO: 4233 - RNA, 75 nt, Mus musculus
cugcagauggcacagugaggccacaaauccccauagagagaugagaaggauauggagcagacuguguucucuguu

SEQ ID NO: 4234 - RNA, 102 nt, Mus musculus
ccuccuaagcagugcaauguuaaacuuugccaaacuccccaagcuaguuuugccuagcuuugggacuaguguguauuuguguucaacagcuuuuguuggagu

SEQ ID NO: 4235 - RNA, 129 nt, Mus musculus
cagguaguuggcuacagcaacaaggaugacgaacacagaugaauugaucaggauguaaccauucaaaguugagagguuugaugcuucgaaaucuuuuccaucuuugauauuugccuuaguggcugccuc

SEQ ID NO: 4236 - RNA, 104 nt, Mus musculus
aucugggcauccucccagagucuagauaaugugagggaacuaggaagaugcuugccagcauccaguguccagcaagugaggcacgggaggacaauguuacagaa

SEQ ID NO: 4237 - RNA, 108 nt, Mus musculus
uucuuccugacccgcucuggcgcccugguccugucagcugggucaucccugagcagcagggaacgacgcagguuugccggguccucuggucccugagccgcagaaggu

SEQ ID NO: 4238 - RNA, 94 nt, Mus musculus
gcccugcccacgaagcacacugagugcagugggcugacuaucuaucuccuuaaugaguucauuugucacuccaagugucacuguuggccuggcu

SEQ ID NO: 4239 - RNA, 99 nt, Mus musculus
agcuguugccuuucccaggggccgaggagacugugccuugaaugugaauccuucaaaguagcuccuugcugugucccugaguggggccaggucucagcc

SEQ ID NO: 4240 - RNA, 91 nt, Mus musculus
agcuggcccucucugcccuguuuaaagaguuugucuuuucucagauagauagaugucuuuauauaguccagacaugagucuucugucagca

SEQ ID NO: 4241 - RNA, 111 nt, Mus musculus
acaggugacuaggggcgaaggagccagugcuucagaccucagaggccucucugacuagggggagguauccgggcaggagagguaccaggggccuuagcuccuaguccugga

SEQ ID NO: 4242 - RNA, 93 nt, Mus musculus
gcagucucucccucaaauucucacugaaagaauccuggauaugcaugaggcgauuucuggagacuuucaguggagugagucuaaaaggcugcu

SEQ ID NO: 4243 - RNA, 102 nt, Mus musculus
aaggauagucuuuuuuuuugggggggggcauauauucaccucuauuuaaauuuuuguuuaugaguggagaggggucaaugaaccucagguaaggauguccug

SEQ ID NO: 4244 - RNA, 84 nt, Mus musculus
gguaguuuaucagauaccauuguuugauccuugaaccuuuuagagguaaagcuguugcaaugaugguauucugaggcacucucu

SEQ ID NO: 4245 - RNA, 92 nt, Mus musculus
caaugcggcugugucuugcaggaagcuuacgucuccuuagugagcaugugcucaccuugggagauucuugcugcuuggugcucgcuguguuu

SEQ ID NO: 4246 - RNA, 109 nt, Mus musculus
augccucaaacauuuccaucugaaaugauaccauaacugggcacuggcgauucucaucggacagcuguuacacuccaguggugucggguacagggaauauuugaagcag

SEQ ID NO: 4247 - RNA, 80 nt, Mus musculus
gggaugggaauauuauaacuguuuagagggaggucaaagaggcacaggcgcucucugagcaguuuucccaggaacccgca

SEQ ID NO: 4248 - RNA, 129 nt, Mus musculus
auugucccaaccagucuggcucacccacugccgccugugcggccgcugccucugucaccccauuagcaacuuggcaaaggcgcuguuucccaguggcagagccccugagccaucugggggcggggcaga

SEQ ID NO: 4249 - RNA, 94 nt, Mus musculus
acauucuacacagcccuguacaucaugucccaucacuagaggacagugaagucucugugggaagugacaagggguagggggcaggugguggugg

SEQ ID NO: 4250 - RNA, 124 nt, Mus musculus
ucaccccauccagcuuuccaagggcuucuuucugacuuccuggcuugauuuggguucauggugagaccagaccccaagguuguccagaguuugaagugggaagcagugggaagcaguggggugc

SEQ ID NO: 4251 - RNA, 120 nt, Mus musculus
cccaaccugguggucacccacauuccgcgaccucaggcugacucauguagauccagcuccacaucuggcauccacauguggcuggcacuccaggaagggggggggucacaucuggcugga

SEQ ID NO: 4252 - RNA, 101 nt, Mus musculus
gugaggugacuuccucgggugccacauugcauucuggggagcagcagggaagccuuggcugucccugacagggcaagugucauuuggaaguaauauucaca

SEQ ID NO: 4253 - RNA, 91 nt, Mus musculus
aggcacagggagggacauucuguucaagcucagcuacagcagggaugcuauggccacaugggcuugcaugggaugguccuuugucgggcug

SEQ ID NO: 4254 - RNA, 92 nt, Mus musculus
gacgagcaauaacagcuagcgcgcaugcguggaccagagacaaagcuguccccguguuuacaaacugugcgggugaggaugugugcuccucu

SEQ ID NO: 4255 - RNA, 104 nt, Mus musculus
gucuuggcucagggacuacucugugcuccuggggaccuuguuuggaaggaauguguugaucuaguucuccagggguagggccgaggaguuccauggcccuggac

SEQ ID NO: 4256 - RNA, 108 nt, Mus musculus
auccugguugcauguggacuguagcauguguaguacauaaugaucuuaucaacaucuguauccuugugaagauucaggcaugcuucuucucuucaaacuagccaggaa

SEQ ID NO: 4257 - RNA, 97 nt, Mus musculus
cuaguuagcuugaugugguacugcacuccuauaaucccagggucuuggaggucuaggcaggaugauuaggaguucgaaaccauccucagcuacuaau

SEQ ID NO: 4258 - RNA, 108 nt, Mus musculus
ccaagugaagcccuugccuguccuugccuaaguuucucucauuacacuaagacucuacuugagacacuggagagauggcucagaagagcagguaguacuugcucuuga

SEQ ID NO: 4259 - RNA, 82 nt, Mus musculus
uauaaggcuuuucagacccugcucuuugggggcuuguagcucccagguuuuccccagucuaaguucugagcugagucuuguu

SEQ ID NO: 4260 - RNA, 100 nt, Mus musculus
cggagcuuuugagggccccaugcauauggccugcugggucucgagaacaccauuuucacucugcugauccgcacugccauuacacuuugaagagucucca

SEQ ID NO: 4261 - RNA, 117 nt, Mus musculus
uccuccguaucaucugcucuucugguggucugcuuacugggaagacugcuccuccucuccccuagagcguucaccugugagucagccuuggcaaagagcagcaaaaggaagcugagg

SEQ ID NO: 4262 - RNA, 116 nt, Mus musculus
acgguaaaagaagaacccaccgaguagcaaacgacagcuagccacauagcugugucugugagacaggguugugugcugcugugauuguccgcuguguguacuaguuccuccgcuga

SEQ ID NO: 4263 - RNA, 115 nt, Mus musculus
agccagaagaggcaagaacacggucaggggaagggaagagaugcacuguccucuaaaaugccugacugcaaccuccuuucuccaggguaccugucaugcugccgcuuccuggacg

SEQ ID NO: 4264 - RNA, 113 nt, Mus musculus
acucacacugcuucaaaauguuaagagcagcagcaaucugacacauggagaaugaaacaguguugcacgugcugcugagucucagaagugaacaguagaugagauaggaaaca

SEQ ID NO: 4265 - RNA, 102 nt, Mus musculus
gggauggagggaaaguugggggugggauggaguggggaguuuuguuucuauaacaacacuaauccuauaaaaucaaacuuccagucauauccucucaucucu

SEQ ID NO: 4266 - RNA, 110 nt, Mus musculus
uugcccaaacuaaacuaauaggauuuaccuauuaacaaacucagguaauguaguguuaaaaagcagagcacugaaaaugcuuagaugggcacuuaucccauaaaaauaaa

SEQ ID NO: 4267 - RNA, 110 nt, Mus musculus
aaccucuucccugggguuagaauuugcaguaacagguguggacauccuagcagcaguuugguggucauguaugauacugcaaacaggagcccugcugaagcuguggggac

SEQ ID NO: 4268 - RNA, 110 nt, Mus musculus
uguccgcuucgccuuagagaagaguuuccuagcggugaguuucucccacuggugaccaggaagguuaucagguggaagaacucagcucaccaacccucucugccuguaga

SEQ ID NO: 4269 - RNA, 110 nt, Mus musculus
ccgugcugccgggcggggaccccgcgggcuccggggcggcgauggggacuaugcuccgggauuccgcugggugacggccgcguccuccuggccgcuugcacuuggggauc

SEQ ID NO: 4270 - RNA, 110 nt, Mus musculus
acacccucccccaggacaguaaagcacagugaugaacucugagggcuuuucacuuccucucggaguugcugguugcucacugggucugugaaugugaauccaugugggca

SEQ ID NO: 4271 - RNA, 108 nt, Mus musculus
ggaauaacugggcaaaggcucuccuaaggcaggcagacuucaguguugcccauuucucaguucucugaagcuugcuuaccuccaaagggccuuugccauagcccugua

SEQ ID NO: 4272 - RNA, 110 nt, Mus musculus
aggauuagaaaucuucauacacacaucaacugagagaguccuugccugagcacaagcccuuccuuuugcacaggcaaggacuucucaagaaacccaugagauggcugagg

SEQ ID NO: 4273 - RNA, 62 nt, Mus musculus
aggcgccucugagcuugugcuugucgccaggcugcgcuagcgagcgaagcccaagcgccaga

SEQ ID NO: 4274 - RNA, 57 nt, Mus musculus
acaggcaccacagguuugagcauuuugauugaauugccaaaccaggcgugccugugg

SEQ ID NO: 4275 - RNA, 60 nt, Mus musculus
ugcuccugguggguggggaagagccuaguucacaucaggcaucuucccugucccacccag

SEQ ID NO: 4276 - RNA, 73 nt, Mus musculus
uuuccuuuguaggcgacgagaacccgugccugguguguaauaaucacuguuucucucucucaccuacaaacag

SEQ ID NO: 4277 - RNA, 62 nt, Mus musculus
cugggggcagugucacacgcuguuuuaugacguaagucucacggucuguguucuucccccag

SEQ ID NO: 4278 - RNA, 77 nt, Mus musculus
aucccuguaaggggagaugcagggagccaugccgaaugaugcuuggauucaagucucuuuguaccuucucuacccag

SEQ ID NO: 4279 - RNA, 64 nt, Mus musculus
caggcagcagaacgcagcgggcaugagauccuuucugaccauuguccuucugugucuucugcag

SEQ ID NO: 4280 - RNA, 60 nt, Mus musculus
ucaugugccaggagaagccuagagccgucuggacucugauggugaugggcucucuuguag

SEQ ID NO: 4281 - RNA, 62 nt, Mus musculus
cuaagugcaggaaugcagaggaccucguggugaaaggaccuucuguguucuugcagcucccu

SEQ ID NO: 4282 - RNA, 64 nt, Mus musculus
cuguguuccucacauugucacaugaaguagaugugaauugucaccaugugauguguggguucag

SEQ ID NO: 4283 - RNA, 88 nt, Mus musculus
cccuuuugggaaaagcaguacuuaccacaugucuucagguggcacgcguguguucacugucgugugugucuguuuuucccagguauca

SEQ ID NO: 4284 - RNA, 67 nt, Mus musculus
uccuuuccugggguuagaguugaguggucguagccuguugcuucugaucucuuaccccagacaagcc

SEQ ID NO: 4285 - RNA, 70 nt, Mus musculus
gggagacugggcagguuggguugaaugauuugaucauguagucacuuaaauaaccuuaucugcccgauag

SEQ ID NO: 4286 - RNA, 58 nt, Mus musculus
gauggaugggcagacggacagacagcagagccuaccugaauuccggucuccucuccag

SEQ ID NO: 4287 - RNA, 71 nt, Mus musculus
gcuucugggacacagggaggcucgauggguuggcugucuucuuacuaacgugcguuucuuuuguguccuag

SEQ ID NO: 4288 - RNA, 63 nt, Mus musculus
gaagcuugccugucagggagagccccaguguguggaugcugacacucucccuugugcuggcag

SEQ ID NO: 4289 - RNA, 62 nt, Mus musculus
gauaacaggggggcuggaaugggcacugcggagaaccaugugccuuccccggccucccacag

SEQ ID NO: 4290 - RNA, 66 nt, Mus musculus
gcaccuggggguagggcaccagugggcagaguguccugcugcucaugguuuccacccuuuguccag

SEQ ID NO: 4291 - RNA, 69 nt, Mus musculus
uggagugggcugagugggucuguggcaucuacccccacaaagccugccucaaucacacucuguccacag

SEQ ID NO: 4292 - RNA, 70 nt, Mus musculus
ugaaguacagggagggugcucaggcaggcaucuggcuguagcaggcuaccugagggucuccuuccugcag

SEQ ID NO: 4293 - RNA, 66 nt, Mus musculus
ugaccugggagaccagucagguguugggcaucaagcaagcuccucucuacugauuugucuccucag

SEQ ID NO: 4294 - RNA, 69 nt, Mus musculus
cugacuccugggguggugguggccacagaaacgaggucuuuaacucuguccaccucuucccaggcgcgg

SEQ ID NO: 4295 - RNA, 69 nt, Mus musculus
aagacaggucagagcagauggagguucgugguauuucucacccucaccaacuuccuuccucgugcccag

SEQ ID NO: 4296 - RNA, 63 nt, Mus musculus
gcaggcaggaggauggagaugagucacgggguucuuagaugcuuggucucccucuuccuacag

SEQ ID NO: 4297 - RNA, 61 nt, Mus musculus
gaagguguggaaggggaguugugccgcagucuucagccugucacuucucuucccaccacag

SEQ ID NO: 4298 - RNA, 58 nt, Mus musculus
ucuugugcugaggacgggauuagguucucugaagaaugagccugugcccuucucacag

SEQ ID NO: 4299 - RNA, 62 nt, Mus musculus
ugcgguaggccacuggagguggaauugucucugccucugaggcuccuccuccuggcccacag

SEQ ID NO: 4300 - RNA, 71 nt, Mus musculus
uuccuacacaauggaaagacugcuuguagauggcgccaugucuauauacacugcccuuuuccauugccuag

SEQ ID NO: 4301 - RNA, 80 nt, Mus musculus
cacacugaggggcaugagguaggaagccgggaguggggggacaguaaaucugaaacgggugacuacuccuugccucucag

SEQ ID NO: 4302 - RNA, 66 nt, Mus musculus
auuggugugggaggggacuguagagaggagggugccuaaccucuguucugcucacccuucucacag

SEQ ID NO: 4303 - RNA, 72 nt, Mus musculus
gugagggcaggaggauuggggugugaggguccaccccagacgcacuguaugacacucccuccuccuccccag

SEQ ID NO: 4304 - RNA, 63 nt, Mus musculus
uggacagaggauggggauuuggcgaaguuccaggucuuuuacuccuuaauccccacccuucag

SEQ ID NO: 4305 - RNA, 70 nt, Mus musculus
aagccugaggaagagaaggcuuggacugacucauccugauuaccguccccuuuuaucccucagcaaucaa

SEQ ID NO: 4306 - RNA, 68 nt, Mus musculus
ucgggucaguggggugagggauggugaugaaagagccccagcuaaauucaccaucccugucuccauag

SEQ ID NO: 4307 - RNA, 71 nt, Mus musculus
gugaggggauccagcccaggcuagggggaagaaucccugcccguggccugagcuggcuccccugcagcucc

SEQ ID NO: 4308 - RNA, 70 nt, Mus musculus
uuccaaggggauuugcauggacugcacuaagacacuucaguguuccuaaagcuguuccuguacucuccag

SEQ ID NO: 4309 - RNA, 67 nt, Mus musculus
gagggagggaggagcagcaucugugaaggcugccauagaaaccacaggugcugucuucuucuuccag

SEQ ID NO: 4310 - RNA, 68 nt, Mus musculus
uagggaagggggugcuugagagguuugggagcccuuaagugauuuuccuggccucuccauacucccag

SEQ ID NO: 4311 - RNA, 74 nt, Mus musculus
gucacugggguggggagugggggacuucugaaucacuagaggcucuggaaugacccaaccucuucauaccccag

SEQ ID NO: 4312 - RNA, 58 nt, Mus musculus
agucuuuguaggugaaguagacuuggcugacagaugcucuguucugcuuccucugcag

SEQ ID NO: 4313 - RNA, 81 nt, Mus musculus
uggucugucuggcggcagucaggauaccugucuuuccugguaggaaugaguuacagguguuuccucugccgucacacucag

SEQ ID NO: 4314 - RNA, 62 nt, Mus musculus
aggccuugguggagacagcaagggugggaugguucaagccaccucugcuccugccccaccag

SEQ ID NO: 4315 - RNA, 64 nt, Mus musculus
gugggugugggaggcucagggccccugcuacucacucacucagguguucuuugucuuuccacag

SEQ ID NO: 4316 - RNA, 54 nt, Mus musculus
gugagccacugccgugcccgcgcucgcgccggcgcgcgcggucgcucacccgcu

SEQ ID NO: 4317 - RNA, 65 nt, Mus musculus
uagcuguaagggcugggucugugugaucggucuccaggaaacucacagguucccccuugcacuag

SEQ ID NO: 4318 - RNA, 63 nt, Mus musculus
aguguuuggagcuagcuccagagagagugaagucaugcuugucaucuggggcugucuccuuag

SEQ ID NO: 4319 - RNA, 75 nt, Mus musculus
gagccaggcagcugguugguggaagccaugcaacagcgcccccaggugccugaggccucacuugacccgcugcag

SEQ ID NO: 4320 - RNA, 70 nt, Mus musculus
agaggcagggcuggcuggaagguuuuucgaggcuggcucagcaccccuuaccuuccgugcuugcccgcag

SEQ ID NO: 4321 - RNA, 59 nt, Mus musculus
gcaccccugggggacugacggguagcugcugccgccagcuaacucggcugcucccaaag

SEQ ID NO: 4322 - RNA, 61 nt, Mus musculus
gggccuaggaggaggggaacauuugcaacuauaguggcuuaugguucucuccaccucucag

SEQ ID NO: 4323 - RNA, 66 nt, Mus musculus
ggagauggggugagguuggaagcuaggccuaucagugaacccaccugcuuccauaccccuacccag

SEQ ID NO: 4324 - RNA, 96 nt, Mus musculus
gugagagcggggggaguggcaagugagacggaugggcggggcuggcucagacugcuagccccgcccagcucucuaacucuucccuugugcccucag

SEQ ID NO: 4325 - RNA, 68 nt, Mus musculus
cacguccugggaggggcagccccuggugcccacagaaccagagguucugagcucugcccuucccauag

SEQ ID NO: 4326 - RNA, 69 nt, Mus musculus
aaaagaaaagggagagaaagaaaugcaaggugggcaaagcuauuugacauuucuucucuucccuuucag

SEQ ID NO: 4327 - RNA, 65 nt, Mus musculus
gggcucauccaguggagaggcucgugcacgcuccuacugacagcagccucuuucccuggcaucag

SEQ ID NO: 4328 - RNA, 62 nt, Mus musculus
ggaucaguucagacaggacugugacacacuucucugccucuguccuuccugucugaccacag

SEQ ID NO: 4329 - RNA, 68 nt, Mus musculus
gggagaaagugggucuagaaagaggugaaaagaguauuuacuaaaacuuccccuuuuucuauccacag

SEQ ID NO: 4330 - RNA, 73 nt, Mus musculus
cucuguccuggaguggaggacagucagaaaggcaguuguagcauucucugucuugauccucuccagguuguca

SEQ ID NO: 4331 - RNA, 75 nt, Mus musculus
uuucauuguauuugugugauuaaaguauuagaaguauugaaauucugaguuuugcuuuuuucuucacaaauacag

SEQ ID NO: 4332 - RNA, 61 nt, Mus musculus
ccugaauggugggcggugaaacagagagcuuagcaugggucucugacucugccucccacag

SEQ ID NO: 4333 - RNA, 68 nt, Mus musculus
aggguaaggggcaggggcagggauucaagugcccucaggggacacugacccagccucuauguccccag

SEQ ID NO: 4334 - RNA, 60 nt, Mus musculus
uacucuggggcaguucugggggcagauaugcaaaccuccugcagccagcucuuccccuag

SEQ ID NO: 4335 - RNA, 74 nt, Mus musculus
aagggagggccucaggacucaggaggugacccuaacacuuuggagagucucacaccugucuccuuugcccacag

SEQ ID NO: 4336 - RNA, 62 nt, Mus musculus
gcaggcagugagugggugggacuggccuggagucagucacccugaccggccuauccucucag

SEQ ID NO: 4337 - RNA, 64 nt, Mus musculus
acugccagaagagagacaggaucuagggaaaggaugaaucuggaucucuuguuuucucuuccag

SEQ ID NO: 4338 - RNA, 73 nt, Mus musculus
gugggagaagaggcugcugugggugcccccaaguccgcuagcucagcuccucagcugccucuugccaucacag

SEQ ID NO: 4339 - RNA, 75 nt, Mus musculus
gugccugggaaaccugugucgggcugugaguguuuucugggaccugauacucacugcaccgaccugcucucccag

SEQ ID NO: 4340 - RNA, 61 nt, Mus musculus
cugggcaggaugagaagaguuuggcuggaagcccugcucagccaaccaccucucuccucag

SEQ ID NO: 4341 - RNA, 67 nt, Mus musculus
aaagcugacugggaaggaaauggccagggcucucuaacuaaccuguccucuuucuuccuggcucuag

SEQ ID NO: 4342 - RNA, 63 nt, Mus musculus
cggaaaaggaccuggugggagaucucacaucacuguugauaucugcccuucccuguccuauag

SEQ ID NO: 4343 - RNA, 71 nt, Mus musculus
gggaaggugggauggauggcagaaccuggagauucuugucaaacugcuugccucuugccuccaucccacag

SEQ ID NO: 4344 - RNA, 59 nt, Mus musculus
cccccuuggggugugagacuggaaacaucaccauuguucuuucuugucuuccacucuag

SEQ ID NO: 4345 - RNA, 64 nt, Mus musculus
gcgggagagggaggcuauugggcaggagaugaggaagaaccuucugugcucggucucgcuccag

SEQ ID NO: 4346 - RNA, 72 nt, Mus musculus
ugucccucggggauguggacagcacagccaucucagaucaaugagagcaugugcugugugcuuccucugcag

SEQ ID NO: 4347 - RNA, 58 nt, Mus musculus
aaaggcagggagggauaaagaccagucacuauggaaacucaucuuuaucucuccccag

SEQ ID NO: 4348 - RNA, 68 nt, Mus musculus
agggggcgagggggcccugugguuucaagaaggcugucugagggccacaagcgcugucuccccuccag

SEQ ID NO: 4349 - RNA, 61 nt, Mus musculus
guucccagcagaguagggagcaaaagauaaccaagugacucuguuguucccaucucugcag

SEQ ID NO: 4350 - RNA, 67 nt, Mus musculus
guaaguucagggcugggagcagagacugggccugugcgaggucucacgccacccacccugugcucag

SEQ ID NO: 4351 - RNA, 63 nt, Mus musculus
uggggugggggaggguguagaggcugggcuggcagacucaucacagccucugcuucuucucag

SEQ ID NO: 4352 - RNA, 64 nt, Mus musculus
guugggcuggaggcacagggcagaacagguugucuguggcuccuuacuguaccugucuccauag

SEQ ID NO: 4353 - RNA, 78 nt, Mus musculus
ggcucuacggugggagggguggaguugccauuagccaaaucugaccucugggcacucuaacccuaccuacccauccag

SEQ ID NO: 4354 - RNA, 80 nt, Mus musculus
guagguauggggagaggacagggaguugacaguuuccgaauccuucccaucugugcucucuuacccuuccuaggcaaggc

SEQ ID NO: 4355 - RNA, 83 nt, Mus musculus
gugaggcagcaagagauugggggugcugggguggccuagcuaacucagaguccuagaguccucuccacucucuucugucccag

SEQ ID NO: 4356 - RNA, 61 nt, Mus musculus
agucggcuggggagaaagggguuuggcacggugcaaaaaugucucuccuuucuccuccuag

SEQ ID NO: 4357 - RNA, 63 nt, Mus musculus
uuccccagggaaguugagaggaaaauugucgcugaccugcccaucucccucccaacuccccag

SEQ ID NO: 4358 - RNA, 64 nt, Mus musculus
gugaggcgcugugggcacggcuuggccccgaggcuuccaaggcguugccugacccugaccucau

SEQ ID NO: 4359 - RNA, 57 nt, Mus musculus
aaaggaaggggugagagagaagcuggugccauccacggcuucacucucacccugcag

SEQ ID NO: 4360 - RNA, 56 nt, Mus musculus
ggggaggcgcagagacugagcugcucagugcgcgcuugugucugucuggcucccag

SEQ ID NO: 4361 - RNA, 59 nt, Mus musculus
uuaggguggggggggaggcuagguuagcauccacccagcugacuugccuuccaccccag

SEQ ID NO: 4362 - RNA, 115 nt, Mus musculus
gugaggagaaggaagaggcugaaggcugggcuucuggugcuucugggguucagccacacacccacccccagugccacccaggccgaccagugccaacagccuacugucuccucag

SEQ ID NO: 4363 - RNA, 68 nt, Mus musculus
aggggcuggaggaucgcagggguggccuggggcaggcuaggcaaaccuggccccucugccccuuccag

SEQ ID NO: 4364 - RNA, 64 nt, Mus musculus
augacuuggaagggcauacugauucgggagacccuaaagccugaaucaaagucuguuguuccag

SEQ ID NO: 4365 - RNA, 64 nt, Mus musculus
gugaaacugaaaggcaaugaaggaggagcacugucacaguguacuuucuuuccugucuuucuag

SEQ ID NO: 4366 - RNA, 61 nt, Mus musculus
guguauacugagggguggcugcuaugucacucaaagcugacucacagccaccuccucacag

SEQ ID NO: 4367 - RNA, 58 nt, Mus musculus
gggugaggggagcuagguagaaagccagaggcauaugugguuuucaccuuccucccag

SEQ ID NO: 4368 - RNA, 73 nt, Mus musculus
aacagugggacagggugacagggugagacccauagaucagagcugggcuucacccauuucucccugcuuccag

SEQ ID NO: 4369 - RNA, 59 nt, Mus musculus
aucugggguggagagcugaggcccagguagcucagccugaccucuguaucuccugccag

SEQ ID NO: 4370 - RNA, 65 nt, Mus musculus
ggcuguuggggacagaggcacaggaugcuggcugcugaccaccuguccacugucucuggucccag

SEQ ID NO: 4371 - RNA, 91 nt, Mus musculus
gcuugcccagggugagucagggcucuccugucaucugggcccccuccgggcucugggaggccgccacuggagcccugccucuuccuggcag

SEQ ID NO: 4372 - RNA, 70 nt, Mus musculus
agcaguggagaacagggacugggccugauugauggcacucgcuccaaggcagcccuuuguucuucuccag

SEQ ID NO: 4373 - RNA, 109 nt, Mus musculus
auaucugccugugaugguuuggcugaguggaauugguuguguuggagguuaugguaacagccucuuuccugcccuuuaccacaaccuucucacugaugaucauuugcag

SEQ ID NO: 4374 - RNA, 65 nt, Mus musculus
ggcucagugggagaaacgggugucugucuggucucugcugcugacuugcguuuguuuccucacag

SEQ ID NO: 4375 - RNA, 73 nt, Mus musculus
cugucacaaaggugggugaagccggugacgauugcuaguucuucugugucaacgaucuucuccgucuuugcag

SEQ ID NO: 4376 - RNA, 71 nt, Mus musculus
cagaccugggaguagaagggggaaaccagaaaugagggcuuuaaugaugguguguccccuuccucucacag

SEQ ID NO: 4377 - RNA, 61 nt, Mus musculus
ugggcugcacaggacagagcacagucagcaucauccgacggugucucuggucacucugcag

SEQ ID NO: 4378 - RNA, 71 nt, Mus musculus
ccaaguaacaggcuggagaggugcagaacagagucucuggagucucucaaaccuuacccuccuguuuccag

SEQ ID NO: 4379 - RNA, 64 nt, Mus musculus
ugggccugggcagagggcaaagugacucggugacacgggugagagcugcucugugcccacacag

SEQ ID NO: 4380 - RNA, 61 nt, Mus musculus
aaggaaggagagucagcaagcaccuggcuggcccaggcuucagcuguccuccuuucuguag

SEQ ID NO: 4381 - RNA, 63 nt, Mus musculus
agaggaggggacagguaucuggacagagguucugcccucagcacccaccugccuguccuccag

SEQ ID NO: 4382 - RNA, 79 nt, Mus musculus
ggaggaggcagggugugagcgugagcaucccagaggcccagguucaaguccagcccugacgcucacacucccucugcag

SEQ ID NO: 4383 - RNA, 55 nt, Mus musculus
ucuuuggcuucggggaguacguggaaaaugagcgcuuugugcuuccccuugccag

SEQ ID NO: 4384 - RNA, 66 nt, Mus musculus
ucagguguggggagaagcugcggcagccgagagcugcgugucagaggccccggguuuuccccacag

SEQ ID NO: 4385 - RNA, 64 nt, Mus musculus
ugaccuuccguggaugaggccugugccgugacucucagugacacccacucccuccuucacgcag

SEQ ID NO: 4386 - RNA, 69 nt, Mus musculus
aggggccuggggaugggaggaccagcagagaaauuuggcuuuccugugccugcuacccaucccuugcag

SEQ ID NO: 4387 - RNA, 69 nt, Mus musculus
ccauguggggguguucaagacuugggaaccuggcugauuucuuaccugguuucugaccuggauccccag

SEQ ID NO: 4388 - RNA, 70 nt, Mus musculus
ccacaucagaagaggcaguggaggagaugguacacagcacauucugaucccauccacguuucuucuguag

SEQ ID NO: 4389 - RNA, 63 nt, Mus musculus
ugcucugugggagaugccaggagccguacgacuaacugacgugugcuucuugccucuucucag

SEQ ID NO: 4390 - RNA, 64 nt, Mus musculus
cccuuuuggggucaggggaccagagcuccagugacccugucucucuuuuccccucucccugcag

SEQ ID NO: 4391 - RNA, 63 nt, Mus musculus
guuucggaaaggauugggaaacuugacuaaugcaugguaacagguucuccuuuccuuugcagg

SEQ ID NO: 4392 - RNA, 73 nt, Mus musculus
ggcagaggaggaugggagagggaggugugcacccacucaggagcugacacacucugcuucccuccuccucuag

SEQ ID NO: 4393 - RNA, 64 nt, Mus musculus
gacggaaggagaggaguuggcagggacuagcuaugagcauccugaccuguggcuccucucccag

SEQ ID NO: 4394 - RNA, 72 nt, Mus musculus
uucgguaugaagaggccaguguuguagcuugagauccagccuaagccacacuuacuguugccucuuccucag

SEQ ID NO: 4395 - RNA, 63 nt, Mus musculus
aggcuuugggugcuguggaagggacagagacccugagcucuuccucuuucauaccaaccacag

SEQ ID NO: 4396 - RNA, 64 nt, Mus musculus
ugcccucugugcaguaggcuguggguuccaugcugacugacuuucucacuguccucugcacuag

SEQ ID NO: 4397 - RNA, 72 nt, Mus musculus
cgacucagggaggggagcgagaguaggccacuauggacaugcugagccugaccugccuccugcucuccccag

SEQ ID NO: 4398 - RNA, 62 nt, Mus musculus
gucccagaggguugugagacuagggcugugcuuccugccuaacccugcuccucucccuccag

SEQ ID NO: 4399 - RNA, 85 nt, Mus musculus
gugagcagacagggaguggugggggaagucuucuccugggcucccugagcccacacguaacccucacccugcugccggcuugcag

SEQ ID NO: 4400 - RNA, 69 nt, Mus musculus
aggggaucugggaggggcugucaggaguacaggccgacugcaccgcucaccuuggccgccucucugcag

SEQ ID NO: 4401 - RNA, 70 nt, Mus musculus
aggucugggaugguggagagggugaccagauggagacaucguaggcacuaaccccucucuucucucccag

SEQ ID NO: 4402 - RNA, 63 nt, Mus musculus
gagucauaggaguugauuacagagcaagcgcugugucuucaucucugugcuucugcuccuuag

SEQ ID NO: 4403 - RNA, 61 nt, Mus musculus
accuggcaaggaagggcucuguuuagcaugcuggcaauacaagccugaccucugcccccag

SEQ ID NO: 4404 - RNA, 64 nt, Mus musculus
uuggaaugggggagcugggauugggcguggagcuuggaggccucacccugucugcgccccucag

SEQ ID NO: 4405 - RNA, 62 nt, Mus musculus
auggguugggggauggguugcuuggcccuaggcaccugcccagcagucccugcucccuacag

SEQ ID NO: 4406 - RNA, 74 nt, Mus musculus
uggcccgugagcugaagcugguggcucccagugaguuucucaguaggcagcacaacuccagcucaccagccacg

SEQ ID NO: 4407 - RNA, 67 nt, Mus musculus
ugcguuucugagaccaugggguauaugcagugguucugguaacaugugcuuucuggucuuggcuuag

SEQ ID NO: 4408 - RNA, 72 nt, Mus musculus
uccccuggaaaggaagaaacagcagagcagcuggggucccuacaugaagcucggguuucucuccucuuccag

SEQ ID NO: 4409 - RNA, 64 nt, Mus musculus
ugggcugaggcuugggucaggagguuuagacugaaaugcaaaccuucucuucccccucggccag

SEQ ID NO: 4410 - RNA, 61 nt, Mus musculus
guaagucuggacgcucggcugccagcgcccugagcuguggcucuguguguccagaucagcu

SEQ ID NO: 4411 - RNA, 60 nt, Mus musculus
uauccuggggagguggcugugcuaguccacggggucagccuugcucuguuaucucuccag

SEQ ID NO: 4412 - RNA, 65 nt, Mus musculus
gacaaccugagaggccugaagggugggagcagccuugaaugaccaacccucuugcccucuccuag

SEQ ID NO: 4413 - RNA, 79 nt, Mus musculus
cguggcccagggugguccccgagagggugguccccacaugggcaaaccagggguccauccucucgguaccgcccugcag

SEQ ID NO: 4414 - RNA, 81 nt, Mus musculus
uuuagucuccaggagucugaggggcagggucgucuccagcaucuugggcuuggccuaaccugccuccauucucuugggcag

SEQ ID NO: 4415 - RNA, 84 nt, Mus musculus
agggguccgggagggauggaugugcuggaggucccaucuagaccuugacuguccugaccuuggccuuccuucccuacccuacag

SEQ ID NO: 4416 - RNA, 82 nt, Mus musculus
ugaggggcugggagaguggcucagaagagaguaccuggcucuggggaggaaggggcagacuucugagccgcugucccugcag

SEQ ID NO: 4417 - RNA, 65 nt, Mus musculus
cuuccagcgggguucgguggggaagagacugcagcaugcuguccguccucauccgcuccucccag

SEQ ID NO: 4418 - RNA, 63 nt, Mus musculus
acgcgggguucucuguggaagcggcuugcucggcucugagcuuccuggugggccucggggucc

SEQ ID NO: 4419 - RNA, 65 nt, Mus musculus
ucgggaagguggccacaggagaucaugguggcuccuuaccaccugucuccuaaugucaccugcag

SEQ ID NO: 4420 - RNA, 71 nt, Mus musculus
ugcgguguagaaggaagggcugcugugcuugacaagucugucauuuucacacugcuccugccuucuuacag

SEQ ID NO: 4421 - RNA, 85 nt, Mus musculus
ucguuagagggauggagagcaucgcguguuugagucuugugacacuuccauaauguuuccacgccuguucugcccucccuuccag

SEQ ID NO: 4422 - RNA, 63 nt, Mus musculus
ucucccauacggagggagauggaggcgcccucagugguaaccgccacccucucucucacguag

SEQ ID NO: 4423 - RNA, 52 nt, Mus musculus
cucugagagggaauggagacucaguugaccucugguucucuucuucccucag

SEQ ID NO: 4424 - RNA, 58 nt, Mus musculus
agaauuagagacagcagaagggccacuaauuagcuguugucccuuuguuuucucucag

SEQ ID NO: 4425 - RNA, 70 nt, Mus musculus
cugccugugaaagcagagaggcauuuuucucugucgcagcuacuugaguacugugccucucuguuuucag

SEQ ID NO: 4426 - RNA, 72 nt, Mus musculus
cucuugugugguggugguggcggccucacugucaauccacugcaguaccugaugcagccccgacccucacag

SEQ ID NO: 4427 - RNA, 63 nt, Mus musculus
gaaagagcgggugggggagggggacugcgcgucacucacuguucuccccccucccccgcacag

SEQ ID NO: 4428 - RNA, 66 nt, Mus musculus
gucuguguagggugaggcugggagccaggcgaaagagcacagccugaaccacccaucccccuacag

SEQ ID NO: 4429 - RNA, 64 nt, Mus musculus
uggucugagggaggagggcugggucugaagaguugguucucacccucacccuuccuccuuccag

SEQ ID NO: 4430 - RNA, 58 nt, Mus musculus
ggaugcggggcugagaggugaggaagccgagauagcuucuuccauucucuuuccccag

SEQ ID NO: 4431 - RNA, 60 nt, Mus musculus
gugugucugaaggcagucagguaggcggcaccucugaccugcagccccugucugccucag

SEQ ID NO: 4432 - RNA, 60 nt, Mus musculus
agaagacaggagaagggggugagagacucccuccugaacucucagccuuuaucuccccag

SEQ ID NO: 4433 - RNA, 73 nt, Mus musculus
acuacucaccaggaggaaguugggucagguaagggcuucgcagccccccugagccacugauuccugugugcag

SEQ ID NO: 4434 - RNA, 65 nt, Mus musculus
uaucaugugggaagguggaggccuuuccaggauuucaaaccuuggcucugcccccuccuucccag

SEQ ID NO: 4435 - RNA, 73 nt, Mus musculus
ggagcuggggaaaggcaggcuacuggggagcuggguaguucggaagcccagccuccugugucuccuuccccag

SEQ ID NO: 4436 - RNA, 62 nt, Mus musculus
ggaacuaggaaggugguugggcugaguacucacagaacagaguccaacuuggccccuuccag

SEQ ID NO: 4437 - RNA, 59 nt, Mus musculus
ucaguggguuaucugaguugggacuugcuaugauguuugcuacuuugauaccccaccag

SEQ ID NO: 4438 - RNA, 59 nt, Mus musculus
uguggaggaggacagagagguugggcccaacucacagccucaccugucucccaccacag

SEQ ID NO: 4439 - RNA, 58 nt, Mus musculus
gccugcaggagaggacucaaguuggaaaacguucuaauuugaugucuuucuccaccag

SEQ ID NO: 4440 - RNA, 75 nt, Mus musculus
gugaguggguagaggggaggugaccguggaaguugugugcccuuuaucaacuucucguuccuuccuuucuuccag

SEQ ID NO: 4441 - RNA, 59 nt, Mus musculus
aaaccaccggggacugcggcuuucaguuaaaggucacuguuugcuguuuguccucccag

SEQ ID NO: 4442 - RNA, 137 nt, Mus musculus
gugagugcuggguagaaugggaaaugagggauggaagcugcaaccgaggggcuauaggcucaagcugggcuugugaugcucucuguagagcauccuccucucggccccugucacuuucuacucuaccuucuacucag

SEQ ID NO: 4443 - RNA, 68 nt, Mus musculus
gaauuuauggaaauaggaggugauuuugagagaaaguugacugaaauaucccuuuuauuuccuuuuag

SEQ ID NO: 4444 - RNA, 66 nt, Mus musculus
uaggauggaggccagcuuguggagugucuaugaccuaaaccagacuaacuucuccuggccccacag

SEQ ID NO: 4445 - RNA, 91 nt, Mus musculus
uccccaugagaggugcaggcugagcacaaggcagcacaugggacagaugagauagugugacuccccauuugugcucucugccccucuuaag

SEQ ID NO: 4446 - RNA, 89 nt, Mus musculus
gagguucagaggcauaaaggucauuugcuucaguaguaaaggccugggcagguuuggaauggucagcagggcccuuuaugucucucuag

SEQ ID NO: 4447 - RNA, 61 nt, Mus musculus
cauggaguguagcagguaaaccaggaaucucucucaggucuugguuuuccuguuugcacag

SEQ ID NO: 4448 - RNA, 63 nt, Mus musculus
cccuguggguugggaaaugaguagaggcugaccucugaccucuacccauugccugccucccag

SEQ ID NO: 4449 - RNA, 63 nt, Mus musculus
agggcugcagggggugguugcacacggacagucucuggacacugauugcuucccuccccacag

SEQ ID NO: 4450 - RNA, 74 nt, Mus musculus
gugaggcucaguauggggugggggugucgucgccugcccgacugaccacccacucacccuggacugacucucag

SEQ ID NO: 4451 - RNA, 62 nt, Mus musculus
aguguuugggggccugggagggugacacugaggucaucagccugcccugccaaccccuacag

SEQ ID NO: 4452 - RNA, 86 nt, Mus musculus
gugaggggagcugaggcaggaggccaagcaggcuaggaggugaggaaccucaaggauaacuaacuccaggcucuccuucccuccag

SEQ ID NO: 4453 - RNA, 69 nt, Mus musculus
gggggcccgggagcgaggugcugcagcgcgcgugcucacuacgcgacucugacgucucgguucccgcag

SEQ ID NO: 4454 - RNA, 60 nt, Mus musculus
aaugggaggggagacaagaggcaaggcacccuacugagccuagcuucucuucuuccccag

SEQ ID NO: 4455 - RNA, 64 nt, Mus musculus
cuuucugggggaauugaaagacuaugacuuaacaauuaacugauagccuuuuccuccccaacag

SEQ ID NO: 4456 - RNA, 63 nt, Mus musculus
uugggugggaagaggcuagggcuccaguccagcagguaacuaggccuucuccucucccugcag

SEQ ID NO: 4457 - RNA, 82 nt, Mus musculus
ggccgcggggaggaggacaugguuuuggggggcaugacuugggguccggggcucgcggagccaaccaugucuucuuucccag

SEQ ID NO: 4458 - RNA, 74 nt, Mus musculus
uuuccaggggaggugguauggucucagcgggguccggguuggcugugacaacaugacuaccacugucuccccag

SEQ ID NO: 4459 - RNA, 57 nt, Mus musculus
uaggccaaggucccauggcaggcuauucccugacacaccuuccauggcuccuggcag

SEQ ID NO: 4460 - RNA, 64 nt, Mus musculus
cagggugugggugguaggagacgcuggcugguauuugaccagguacuuuuuuuaucauccacag

SEQ ID NO: 4461 - RNA, 69 nt, Mus musculus
cccggagggcugaggcagugaguccugugcacagguccuguaggcuccugacuucuguucucuuuccag

SEQ ID NO: 4462 - RNA, 67 nt, Mus musculus
guaggagcuggagguggguuuggcauagcgcugcaucgggccaggcucaccccuccguucccuacag

SEQ ID NO: 4463 - RNA, 75 nt, Mus musculus
auuucagaggagggugcucggccggggauuauaaaucugugguaaaguaguauuccccugguauccuccucacag

SEQ ID NO: 4464 - RNA, 92 nt, Mus musculus
gaagguacgggcaggaggaggggaggcacagggcugggcaacccuggcucugggaggccacugaccuggccccccuugcugucugucuccag

SEQ ID NO: 4465 - RNA, 60 nt, Mus musculus
gagggucggggcuggacaagcagagacaugugcucaucccucugcucuccuggaccccag

SEQ ID NO: 4466 - RNA, 70 nt, Mus musculus
gcuucuagaggauagagguagagaguggccagcugcugccagccucugaccccuguccucugcaccacag

SEQ ID NO: 4467 - RNA, 66 nt, Mus musculus
uggugcagugggggcaggccagcaggagcagagcccaaguccuagcuggccucuccccaccuucag

SEQ ID NO: 4468 - RNA, 65 nt, Mus musculus
cucuuaagaggagaaagguuugggcacaagcuguucccucaguguccguucugauaucuccucag

SEQ ID NO: 4469 - RNA, 70 nt, Mus musculus
guuggaggcagguguggagcuggucucugcagagcagacucaguaggcugcuggcucucuccccugccag

SEQ ID NO: 4470 - RNA, 86 nt, Mus musculus
gcaagugguggugaggaggggaaacaggcugaguaacaggggccacgaggccucaggcccuguugaccuuccuccauugcuuccag

SEQ ID NO: 4471 - RNA, 68 nt, Mus musculus
cugggccgugggaccuacagacuccuggguguggcuuagcaggugcucagugucugcugucuccacag

SEQ ID NO: 4472 - RNA, 62 nt, Mus musculus
aguucucagaguugggacaccaugagggcuaacaggccugccuuugaugucugacuuugcag

SEQ ID NO: 4473 - RNA, 79 nt, Mus musculus
guaggggugauagauuccauggcagaggggauggugcaaaugccuuuuagcaagacgcaguggcuucugucgucucuag

SEQ ID NO: 4474 - RNA, 68 nt, Mus musculus
ugucuaaaggcaaacucacagaaucauuuucugaaaaaauaaaauguucuuuguuuuguuugccuuag

SEQ ID NO: 4475 - RNA, 101 nt, Mus musculus
gugggcaggaugacagaaggaaaaccuaucagauaguuuguucauaauccuucucucucaacagcacuuaguguccauguuuuccaucugucauccugcag

SEQ ID NO: 4476 - RNA, 60 nt, Mus musculus
ucugaagaggauacagggucugaagugacaaugacaucuacucugcuguucucuccacag

SEQ ID NO: 4477 - RNA, 60 nt, Mus musculus
ucuggagaggauacagggucugaagugacaaugacaucuacucugcuguucucuccacag

SEQ ID NO: 4478 - RNA, 64 nt, Mus musculus
gucggggguuguggugccgaauugucugugucacccaaagccacuugguccccugcccccacag

SEQ ID NO: 4479 - RNA, 70 nt, Mus musculus
aacagugaagacaucaggaaaaaaaaaauaagaaaugauaaaccuuuuuuuuuuuccuuugccuucucag

SEQ ID NO: 4480 - RNA, 65 nt, Mus musculus
ugugaucugggggcucagcugaggauaagcccgccuugucaccgcuguccuucucuuucccccag

SEQ ID NO: 4481 - RNA, 61 nt, Mus musculus
gggucuggggaaggcgggagagggaacagaacaacagcuaacucuacguccuccuccacag

SEQ ID NO: 4482 - RNA, 59 nt, Mus musculus
aaggacugggggauugggugccuucuuuuuaaaaaaagaaaaaacaccguuuccuccag

SEQ ID NO: 4483 - RNA, 54 nt, Mus musculus
uaacauuguagacaggcacaaagauccccuuuauauguaaguaacaauguggcu

SEQ ID NO: 4484 - RNA, 63 nt, Mus musculus
ucuuucccucugccacuccaccgcugggagcuugugucuguggagugacuguagggaggaugc

SEQ ID NO: 4485 - RNA, 61 nt, Mus musculus
ucugggggcuugugugguagggggaaucugagcgagacccuaacacacacgucuccagguc

SEQ ID NO: 4486 - RNA, 57 nt, Mus musculus
acugggucucuugagguagccugaaaggaaggggggcuaccucaagagagccagucu

SEQ ID NO: 4487 - RNA, 61 nt, Mus musculus
uguuuucuggguuggaaugagaaugugucuccccacccucaguccugaccccuugagcgca

SEQ ID NO: 4488 - RNA, 51 nt, Mus musculus
gcucuuuauguccaagcugagcuacaaaugcucugagaggcagaaaagcgg

SEQ ID NO: 4489 - RNA, 76 nt, Mus musculus
uggagagcuggcagaggacccagacaagccaccugcgaaagcaauuuggcuucuuuggaauuuggucuuuuccggc

SEQ ID NO: 4490 - RNA, 62 nt, Mus musculus
aacuuguaucuugugagacagaagggcacgccuacggcccugagaacccacaagcaagaaga

SEQ ID NO: 4491 - RNA, 59 nt, Mus musculus
ugcaggguuuaguguagaggggacauagaugaccucuaaccugucauucuagccugggg

SEQ ID NO: 4492 - RNA, 54 nt, Mus musculus
uguguuagagcucaggguugagaucaugugaucuauccggguuucuaacacacu

SEQ ID NO: 4493 - RNA, 60 nt, Mus musculus
ggugagcucuugguaccuuggcgacaagaaggugagcccaggaacaaggucucaguccga

SEQ ID NO: 4494 - RNA, 72 nt, Mus musculus
cgucucuuggucacagguggguucuagagagacuagaguggaggucagcccugacugugggcuggggacugg

SEQ ID NO: 4495 - RNA, 75 nt, Mus musculus
ggcacuugccaggcucugagcuggacuacauacucugugcugaagugucucauccaggacagugggcaggagcag

SEQ ID NO: 4496 - RNA, 69 nt, Mus musculus
uagcuuugcugaggugucggggugugucauacccacacugguaacauucccugucucgaacaagcuagg

SEQ ID NO: 4497 - RNA, 60 nt, Mus musculus
ggguaggccccucagugaagauuucaggacacuuagaucuccacugagaggaccacccac

SEQ ID NO: 4498 - RNA, 54 nt, Mus musculus
acguagacuguguagaagcccucuuggcacugcuucuagacagccucugcagca

SEQ ID NO: 4499 - RNA, 60 nt, Mus musculus
gccagggaaguugauugugugaagggagcaggacuccugacacagccauucucugagcag

SEQ ID NO: 4500 - RNA, 59 nt, Mus musculus
ucugaugacuuuuucauugaaaaauacuugcuauuucucugaaaagggucaucggcaga

SEQ ID NO: 4501 - RNA, 39 nt, Mus musculus
uggcgaccugaacagaugucgcaguguucggucuccagu

SEQ ID NO: 4502 - RNA, 53 nt, Mus musculus
uaguagacaucccuggauagccucaaggcuacacagaccagugacuuucugca

SEQ ID NO: 4503 - RNA, 56 nt, Mus musculus
agacugcuguuucucugaguggcuucugggggcuugaguugagacugucaguaggu

SEQ ID NO: 4504 - RNA, 61 nt, Mus musculus
uuggggaacacuggggcauacccaaugcucagaccuaacuugcuucuuuguuuccccagaa

SEQ ID NO: 4505 - RNA, 74 nt, Mus musculus
uacauggaugauuguuuuuccaaggcuuucguagcaagcacacgaaaagucuugguugaauucgacuuuggggc

SEQ ID NO: 4506 - RNA, 60 nt, Mus musculus
aguuagggacagauagauggcaagcaagucuugaucuauauugucugccuuuaggucuac

SEQ ID NO: 4507 - RNA, 52 nt, Mus musculus
uuguuuucuccaaagacguuucuagguagaaacgucuuucuaggguagaagg

SEQ ID NO: 4508 - RNA, 56 nt, Mus musculus
ggagggaggggucugggcagaagugaagcuggcucugacuucuugcuucucuccuc

SEQ ID NO: 4509 - RNA, 60 nt, Mus musculus
ccuaaaacugugugguccaaugccauuuaacuaccagguuggaccgcacagauuuagacc

SEQ ID NO: 4510 - RNA, 63 nt, Mus musculus
augguagcuugugacaggacuggcccuugggagagcaaagccauccuguugagcuuaccgagc

SEQ ID NO: 4511 - RNA, 43 nt, Mus musculus
augcggaugggacgcggcagcagcucgccuguccuuuguguuc

SEQ ID NO: 4512 - RNA, 57 nt, Mus musculus
gccauccugacaaagcccuuuucugcucaagccacaauggcucugucaggcagguag

SEQ ID NO: 4513 - RNA, 58 nt, Mus musculus
uuggagaggaccgccgucggacuccuccugcccugcccgccguugguccucuccaaca

SEQ ID NO: 4514 - RNA, 64 nt, Mus musculus
acuugcaugaguuaauacccaccuggcuaucuccagccugcguaguagauacucaugggagagc

SEQ ID NO: 4515 - RNA, 79 nt, Mus musculus
auugggcuugggaggugcuugugcucaaagccuccuucuccaugaaggggcucaccuuggcagcucggcucuacucugg

SEQ ID NO: 4516 - RNA, 52 nt, Mus musculus
ugcugucagcuguucugagugcuaaaagcaacucagaacagcugacagcagu

SEQ ID NO: 4517 - RNA, 82 nt, Mus musculus
ucuuuagugaaggagaaaggggcuagguggugggauagguaacugagacucaacgccacauggcucugucuucugccucaga

SEQ ID NO: 4518 - RNA, 54 nt, Mus musculus
acaagagaacugaucagugcugaaguaauguccucacuggucgcucucuuucac

SEQ ID NO: 4519 - RNA, 59 nt, Mus musculus
aacuaccaccuccuggccuuuuuuuuaaaaagcaccaaaaguccaggaggugguaguac

SEQ ID NO: 4520 - RNA, 53 nt, Mus musculus
ccgcguuccgggcucggcgcuccgggcugcccagggcugggcccgggacgcgg

SEQ ID NO: 4521 - RNA, 56 nt, Mus musculus
ugacagcagugcuguagacauggucucucagcaucucuccagcacugcuuguuucu

SEQ ID NO: 4522 - RNA, 59 nt, Mus musculus
aauccucuugcaacccagaacucauugcucaguaugaguuuugauauauacaagaagga

SEQ ID NO: 4523 - RNA, 64 nt, Mus musculus
aaguggaaagccagccugagaugcauugugauaaucugucucaguuugguuuuuuuccccuuga

SEQ ID NO: 4524 - RNA, 56 nt, Mus musculus
uaagggcacagggauuucaggcaugugccaccaugucuggcuuuccuguggcuucu

SEQ ID NO: 4525 - RNA, 61 nt, Mus musculus
uaaggggcggacagacagacggcaggaagggucagcaugccccuacuguuccaccccgccu

SEQ ID NO: 4526 - RNA, 70 nt, Mus musculus
ggagucgcgcucccgcucgcgcuccaccaacgcggcggcaucccggcgcgagcgggagcgcgccucgucc

SEQ ID NO: 4527 - RNA, 58 nt, Mus musculus
cggcccacggagcuccuaaagacucgcccugccggguuuaugacgcuccgugggccug

SEQ ID NO: 4528 - RNA, 62 nt, Mus musculus
ugugggaucagauagccuguuaguguuauccuacacugguacaggcugucugaucccacggu

SEQ ID NO: 4529 - RNA, 57 nt, Mus musculus
aauaguuggauaguuagguaaaauaacagucuuuuuccuugcuauucccaacuuggu

SEQ ID NO: 4530 - RNA, 57 nt, Mus musculus
ugugggcguggcggugcuggagcugcucaacuucccaccaccuuccucacccacgcu

SEQ ID NO: 4531 - RNA, 58 nt, Mus musculus
aggagccggcuccagauuccuguguagcugccuccaggagucagcuugucgguucaug

SEQ ID NO: 4532 - RNA, 63 nt, Mus musculus
uuugcccuggcuucagaucucggcaaccaucacuaacuagaucuguaagugaugggcaaagua

SEQ ID NO: 4533 - RNA, 61 nt, Mus musculus
aagaaagaaaccuggaguuuaaaguagcucuuguaauccuugacucccaguuucucucugc

SEQ ID NO: 4534 - RNA, 61 nt, Mus musculus
agggcugaggccuggauccagcauacugcuucagagcuggagccaggcggaucagccuugc

SEQ ID NO: 4535 - RNA, 61 nt, Mus musculus
gcugcuuggugaucauccacugucgugggacuucuucacaguguggaucauaaggagcucc

SEQ ID NO: 4536 - RNA, 63 nt, Mus musculus
caguuuaccugucuaugagauggaaguacuugguauccuaucucuuaggcuggguuaacuaau

SEQ ID NO: 4537 - RNA, 63 nt, Mus musculus
aagggaaggcaggagaaaggcugccuucauaugguggaagcagccaggucccuguccccuaca

SEQ ID NO: 4538 - RNA, 55 nt, Mus musculus
guagcccgggcggugcuuccccgagagucgccgugggaugcagcgcacgggcgag

SEQ ID NO: 4539 - RNA, 63 nt, Mus musculus
gagccaucucucuagccccugauauacuuuuaauaugcuucagggacugcagagauggcacug

SEQ ID NO: 4540 - RNA, 59 nt, Mus musculus
cacucugaauaaccugcucucuguggaagaaaccaugcggugcaggggauucagaggag

SEQ ID NO: 4541 - RNA, 58 nt, Mus musculus
aguaccaccauacacagcuuuuguuguuguaagacgagcugggugugguggcacaugc

SEQ ID NO: 4542 - RNA, 69 nt, Mus musculus
auucagaugggcagauugggaaguagucuuugcacaugaugcuggcuucccuuucugaauaucuguaga

SEQ ID NO: 4543 - RNA, 58 nt, Mus musculus
aggcuccgcucuggcuagcuuccuggaaagggagggaagcgggcaggcggagaaccac

SEQ ID NO: 4544 - RNA, 62 nt, Mus musculus
cgguggacuugacagcgggcgacucuggaucucugaucucgucggcugccagguucaugugg

SEQ ID NO: 4545 - RNA, 64 nt, Mus musculus
uuugacugagagguaaggaaugaguuauacuguguuacucauuccuuaccucaccgucaaagga

SEQ ID NO: 4546 - RNA, 63 nt, Mus musculus
ugaggugugggcagcaugaggacuagggccaugacaacccugucccauucucaccgcacccag

SEQ ID NO: 4547 - RNA, 58 nt, Mus musculus
cuuacgaaagaaugaagagcaagcuguguucugggcuuguuucauuuguucgugacuc

SEQ ID NO: 4548 - RNA, 62 nt, Mus musculus
agggcaguaugauggccucugauuaugucacuccuggagauccggugcucacucugcccaca

SEQ ID NO: 4549 - RNA, 62 nt, Mus musculus; identical to SEQ ID NO: 4548

SEQ ID NO: 4550 - RNA, 67 nt, Mus musculus
aguggugagcagaaagcagccgcgguguguggcaccgucgcucaccggcuguguccucucaccuagg

SEQ ID NO: 4551 - RNA, 71 nt, Mus musculus
uuacaagggcuggauaggaaugaucuagcugguuccuauguugaaggucuuuccuuacuuucucuuguagc

SEQ ID NO: 4552 - RNA, 63 nt, Mus musculus
aggcuggcaccaggaucccugauuugagauucuuacugucaggaucccaggguaccaaccagc

SEQ ID NO: 4553 - RNA, 54 nt, Mus musculus
auuccagugaacaagcaguucgguaugcacgaacugcuuguucacuggaauagg

SEQ ID NO: 4554 - RNA, 72 nt, Mus musculus
auccuguccuugcccucucuguuggcaucagaaaccuacaccuacacuacagaaagggcacugacaggauag

SEQ ID NO: 4555 - RNA, 58 nt, Mus musculus
aggcacgacucuugccacagaaacugagugcauuuguccuguggguuggguuggcuuu

SEQ ID NO: 4556 - RNA, 61 nt, Mus musculus
uuccguguuucgucugaccacugggauucucauaacucacuggaaagguggaacacggaac

SEQ ID NO: 4557 - RNA, 60 nt, Mus musculus
ucugggaagccugggcagcaguggggcaaccauggagcugcugacuggggcuggccugug

SEQ ID NO: 4558 - RNA, 62 nt, Mus musculus
accuuccgguuucuucaagucuccuguccugcaaugccaggagacuuggcuuccggcuggag

SEQ ID NO: 4559 - RNA, 57 nt, Mus musculus
ccuuccacuggaccuggggcugggcgcuuuccugucugcucggggcacuguaagaga

SEQ ID NO: 4560 - RNA, 59 nt, Mus musculus
aggcggggaaccugaggcgcaggcugugucugacucagccacucagucgccccgccaca

SEQ ID NO: 4561 - RNA, 56 nt, Mus musculus
uagcugggcaugaucugaugagcucacagccaggcucuggcuuaugccuagcuuuc

SEQ ID NO: 4562 - RNA, 59 nt, Mus musculus
ccgaggcagccuggcuuaguggaaaaggaacaggcuuuagagccagacugccuggguuu

SEQ ID NO: 4563 - RNA, 136 nt, Mus musculus
guagcucagaguuuuaaguuucacccaucguacagggaaguccaggccuccgcacugggcuccugaugugcagucagaagcgcaguggaggucuguguacugcccacgucucuuccugcuuuuauauagucuguga

SEQ ID NO: 4564 - RNA, 139 nt, Mus musculus
uggagauuuccuuguagggugcuuggauuagguuagggggaggagugagugguaagcuggugggaugcuuccaguucccaccaguuuauaauucauuccguuacuuuucuggugguguuuucaguuuucaaaguucacu

SEQ ID NO: 4565 - RNA, 87 nt, Mus musculus
gcagcgcggcgcucggcuuuccggcaguacccggauggagggguaauggccgccaucugggacucgcaggcaauggggaccacggca

SEQ ID NO: 4566 - RNA, 137 nt, Mus musculus
agagaaggugagugucuuuccuagcccugugucugaguccuuggggagcagagcaugaguggagggguucccugcucccugugugcuuucugcucuccuacagguggaccuggcagugguggaggugggcauuggcg

SEQ ID NO: 4567 - RNA, 117 nt, Mus musculus
cacggguugcagcaguacuacgugaaacugaaggacaacgagaagaaccggaagcucuuugaucuucucgauguccucgaguucaaccaggucaguaucgagggucuguguaggcga

SEQ ID NO: 4568 - RNA, 129 nt, Mus musculus
cguaauggcugugggcaugcugagcugaggagaagaaaggauucugcugucugucccaugguuauuggagaugagauguaggccugugucaccccagacaguucuacuuuguagcccugguuggucagg

SEQ ID NO: 4569 - RNA, 127 nt, Mus musculus
aggucucaguaagaacucaaggccgugacuugacugggcacgguagcugaagaguacaggaauccucgcagacucuucuugcuacccugccuccccagcaggucugcaagucugugccugagaaccg

SEQ ID NO: 4570 - RNA, 119 nt, Mus musculus
uauggugcuacugagcauuuucuuuugguaaacaaggaaaauguccgggcugcagccgugugccguccgucguuuuccucgcugcauccauuaaucugcuuagagaacacuagugccag

SEQ ID NO: 4571 - RNA, 137 nt, Mus musculus
gccggcuugcggcuaguguggcggcgguguugguuuuggaagccagagcgggcacauucccuggacaggcggcagggcuauggucgcuggcucccaaaggcccgcuccgcuucgcagcccgauccugagcgcaagcc

SEQ ID NO: 4572 - RNA, 127 nt, Mus musculus
uuagucaguauccaccacgcugccuucucucagagccaaggcgugggaaagguuguagggaguucuuaguuacaacugagucccacccuuuaccuugggaguggggaaaacucagcgcagucugcca

SEQ ID NO: 4573 - RNA, 127 nt, Mus musculus; identical to SEQ ID NO: 4572

SEQ ID NO: 4574 - RNA, 121 nt, Mus musculus
gccagcaaguaaacaaugacugucccaggaaggaggaaagggagcaagcaggugugaccuucuccgcccgccccuuccuuuccccccucugggucuggagcacugggaacuuacuuggcuu

SEQ ID NO: 4575 - RNA, 111 nt, Mus musculus
cuccgaauguuguuguugguggcggcggcgagcggagccggaggagccgccgcaaagauggaggagccgucgaggaggcgcugccgcugcuguugccgccgcugcugccgc

SEQ ID NO: 4576 - RNA, 139 nt, Mus musculus
gguaccgcccguccccgggcgcuugcagcugccccgcccacuccuccucucccggccugaagggaacccagccggcuucacgcgggggaacgaggaagacuggggauggacagccucgaggcacucggcaagaagggcu

SEQ ID NO: 4577 - RNA, 107 nt, Mus musculus
ggggagccagucugcagacaagaaggggagcagggagcaggcggaguggaaggaguuaccuucuccuguucucuguucucccucugacugcaggagcaaagggcaug

SEQ ID NO: 4578 - RNA, 101 nt, Mus musculus
ccggaguuccucgggcugucucaggaugagguggagugcagcgcagaccacaucgcccgccccauccucauccucaaggagacccggcggcugcccugggc

SEQ ID NO: 4579 - RNA, 89 nt, Mus musculus
ugcuugaaccugggucgaagaaucggggcucgccagccgacuccuaaagcggaggcgacuggcgagacccgaagaucagagggaggaga

SEQ ID NO: 4580 - RNA, 139 nt, Mus musculus
gaagacagucuuguuggaaaagcagcuuuacaaagugaaacauaaaucccaugugcagagucacugaguagcugaggugacucuguacauggcauuuauguuuuacauuucugugauuucucaucgagcagcugaggug

SEQ ID NO: 4581 - RNA, 117 nt, Mus musculus
augauucuucaugccugccgcugggaaaacuggaaacuaguggcugggacagcaggcagacagaaccugacaucucagcccucuguuucccucagguccccaguucggccauggaua

SEQ ID NO: 4582 - RNA, 109 nt, Mus musculus
acucaugcauguguucucuacauucugccgcuuuuccccugaggcauauccagauaagacccucuggggaggagcguaguuacagaaagaaauguaggcucuuauuuug

SEQ ID NO: 4583 - RNA, 117 nt, Mus musculus
gagccccggcucauuuaagcagcgagcgcagcgccgcgugccggccgcggggccacugcgcacgcgcagccccgcccucccgcgugccccgcccgccacucgcuucccgggccucgc

SEQ ID NO: 4584 - RNA, 97 nt, Mus musculus
augcuguugccuccccuugcccuaacagccguuuguuaggcuuaaucugaauugagaagcguggauugggggggggggggugcaaagcccaaagcua

SEQ ID NO: 4585 - RNA, 137 nt, Mus musculus
ccaccuaccucugccucaugagugcugggauuaaaggcgugcaccaccacgcccggcgagauacuaauuuuuauacaccgggcaugguaguguacaccuuugaucauagcacucagagaaacugaggcaggugggcc

SEQ ID NO: 4586 - RNA, 131 nt, Mus musculus
cuccgccuccucccccccucccaccccgccugcucugcggcggaggcggcggcggcggcagcggugucucugccucuccgccaccuccaccgcagccucugacccccggccggcguuguuggcggggaggg

SEQ ID NO: 4587 - RNA, 129 nt, Mus musculus
gaaauucauacccugugagugagucucgggggucucaggagagucaggggcaaguagacaccccaggucucuaaagaucugugguguccuguuucuccuggcucuccucucucccaagguuuucuuauc

SEQ ID NO: 4588 - RNA, 111 nt, Mus musculus
cgagcagccagcgacccugcagagcggagaaugggaguagagcagagugucugaacagcacgcucacccaucuccucuccgccucgcucuccugaccuguucacccaucca

SEQ ID NO: 4589 - RNA, 119 nt, Mus musculus
cccuggaacuggaacugcaggugguugggagccaccauggugguguugggaagugaacuugaguccuccgcaauagcaacaagggcucuuaacuacugagccaucucuccaccuucaaa

SEQ ID NO: 4590 - RNA, 97 nt, Mus musculus
gagccugguguugaggggagaaggauccggggcuaguuggcgucagccaaagggccuuauaaucgccaacuauuucuguaucuucucucuuuucccc

SEQ ID NO: 4591 - RNA, 107 nt, Mus musculus
gggauuccugugugggcccuugcagguguugggcgagacuccgcuggcaagguagccuggggcucguguggaacagaaggggcuugugccccaggucaggcccgggu

SEQ ID NO: 4592 - RNA, 129 nt, Mus musculus
acaagcuaaaacaaguccccauuccugugucggcauagucauguuugugcuuugauaaacaacagggaguaggacaaacaugacuaugcugacacuagaaugcuugcagggaccagaggaaagcaucag

SEQ ID NO: 4593 - RNA, 129 nt, Mus musculus
agguucaaccaggcuggagaaacggaaagaagaggagaggagagggagcuagggucaaauccugucuuuuuucuuugaccccagccucauuuccuaccccgcagcugcccauccggaauggcucugaag

SEQ ID NO: 4594 - RNA, 139 nt, Mus musculus
ccguccucccugccuguucuguccuugucgccgacuugcgugugccuugcaacuuccgagccggaaacuuccuggccggcuaaggagcagggcacccccuccggcuagagaaggcguccggaauaggauuccuccgcgg

SEQ ID NO: 4595 - RNA, 94 nt, Rattus norvegicus; identical to SEQ ID NO: 3409

SEQ ID NO: 4596 - RNA, 96 nt, Rattus norvegicus
cggcaugcucccaggcugagguaguagguuguauaguuuagaguuacaacaagggagauaacuguacagccuccuagcuuuccuugggacuugcac

SEQ ID NO: 4597 - RNA, 85 nt, Rattus norvegicus
gcggggugagguaguagguugugugguuucagggcagugaugucgccccuccgaagauaacuauacaaccuacugccuucccuga

SEQ ID NO: 4598 - RNA, 94 nt, Rattus norvegicus; identical to SEQ ID NO: 3412

SEQ ID NO: 4599 - RNA, 95 nt, Rattus norvegicus; identical to SEQ ID NO: 3413

SEQ ID NO: 4600 - RNA, 98 nt, Rattus norvegicus
ugggcuccuaggaagagguaguagguugcauaguuuuagggcagagauuuugcccacaaggaguuaacuauacgaccugcugccuuucuuagggccuu

SEQ ID NO: 4601 - RNA, 93 nt, Rattus norvegicus; identical to SEQ ID NO: 3415

SEQ ID NO: 4602 - RNA, 89 nt, Rattus norvegicus; identical to SEQ ID NO: 3416

SEQ ID NO: 4603 - RNA, 83 nt, Rattus norvegicus; identical to SEQ ID NO: 9

SEQ ID NO: 4604 - RNA, 85 nt, Rattus norvegicus; identical to SEQ ID NO: 3419

SEQ ID NO: 4605 - RNA, 87 nt, Rattus norvegicus
ugccuacucagagcacauacuucuuuauguacccauaugaacauagaaugcuauggaauguaaagaaguguguauuuuggguaggua

SEQ ID NO: 4606 - RNA, 97 nt, Rattus norvegicus
uguuggccuaguucuguguggaagacuagugauuuuguuguuuuuagauaacuaagacgacaacaaaucacagucugccauauggcacaggccaccu

SEQ ID NO: 4607 - RNA, 95 nt, Rattus norvegicus
ggacagaccagcccugucuggaagacuagugauuuuguuguugugucuguguccaacaacaagucccagucugccacaugguguuggucacauca

SEQ ID NO: 4608 - RNA, 110 nt, Rattus norvegicus
aggccagaacacaugagccaaugcuauguggaagacuugugauuuuguuguucugauaugauaugacaacaagucacagccagccucauagaguggacucccaucaccuu

SEQ ID NO: 4609 - RNA, 89 nt, Rattus norvegicus; identical to SEQ ID NO: 280

SEQ ID NO: 4610 - RNA, 87 nt, Rattus norvegicus; identical to SEQ ID NO: 281

SEQ ID NO: 4611 - RNA, 90 nt, Rattus norvegicus
ggaggcccguuucucucuuugguuaucuagcuguaugagugccacagagccgucauaaagcuagauaaccgaaaguagaaaugacucuaa

SEQ ID NO: 4612 - RNA, 108 nt, Rattus norvegicus
gcgcaguguaugggguuauuuuuacuuucgguuaucuagcuuuaugaagacuccacaccacucauacagcuagauaaccaaagauaacaaccaaccccgccuccuggc

SEQ ID NO: 4613 - RNA, 118 nt, Rattus norvegicus
agcacuccucggugaucuugaaggaguuuuuacuuucgguuaucuagcuuuaugaagaccaauacacucauacagcuagauaaccaaagauaacaacucgcuucccucacaaggcugu

SEQ ID NO: 4614 - RNA, 115 nt, Rattus norvegicus
gcacgcagaaguuguuagagucauuucuacuuucgguuaucuagcuuuaugacggcucuguggcacucauacagcuagauaaccaaagagagaaacgggccucccauucgccggc

SEQ ID NO: 4615 - RNA, 110 nt, Rattus norvegicus; identical to SEQ ID NO: 3431

SEQ ID NO: 4616 - RNA, 109 nt, Rattus norvegicus
ccaaaguuguaacguugucuauauauacccuguagaaccgaauuugugugguacccacauagucacagauucgauucuaggggaauauauggucgaugcaaaaacuuca

SEQ ID NO: 4617 - RNA, 98 nt, Rattus norvegicus
uuggaaccuuaaaguacuguagcagcacaucaugguuuacauacuacagucaagaugcgaaucauuauuugcugcucuagaaauuuaaggaaauucau

SEQ ID NO: 4618 - RNA, 95 nt, Rattus norvegicus
cauacuuguuccgcucuagcagcacguaaauauuggcguagugaaauaaauauuaaacaccaauauuauugugcugcuuuagugugacagggaua

SEQ ID NO: 4619 - RNA, 84 nt, Rattus norvegicus
gucaggauaaugucaaagugcuuacagugcagguaguggugugugcaucuacugcagugaaggcacuuguggcauugugcugac

SEQ ID NO: 4620 - RNA, 78 nt, Rattus norvegicus
uuggccaugucaaagugcuuacagugcagguagcuucuugagaucuacugcacugcaagcacuucuuacauuaccaug

SEQ ID NO: 4621 - RNA, 96 nt, Rattus norvegicus; identical to SEQ ID NO: 3438

SEQ ID NO: 4622 - RNA, 82 nt, Rattus norvegicus
gcagcccucuguucguuuugcauaguugcacuacaagaagaauguaguugugcaaaucuaugcaaaacugaugguggccugc

SEQ ID NO: 4623 - RNA, 87 nt, Rattus norvegicus; identical to SEQ ID NO: 3441

SEQ ID NO: 4624 - RNA, 96 nt, Rattus norvegicus
acauugcuacuuacgguuaguuuugcagauuugcaguucagcguauauguggauauauggcugugcaaauccaugcaaaacugauugugaugaugu

SEQ ID NO: 4625 - RNA, 85 nt, Rattus norvegicus
cagcuucuguagcacuaaagugcuuauagugcagguagugugucgucaucuacugcauuacgagcacuuacaguacugccagcug

SEQ ID NO: 4626 - RNA, 72 nt, Rattus norvegicus
guagugccaaagugcucauagugcagguagguuuugcugcacucuacugcagugugagcacuucugguacuc

SEQ ID NO: 4627 - RNA, 92 nt, Rattus norvegicus
uguaccaccuugucggguagcuuaucagacugauguugacuguugaaucucauggcaacagcagucgaugggcugucugacauuuugguauc

SEQ ID NO: 4628 - RNA, 95 nt, Rattus norvegicus
accuggcugagccgcaguaguucuucaguggcaagcuuuauguccugacccagcuaaagcugccaguugaagaacuguugcccucugccacuggc

SEQ ID NO: 4629 - RNA, 75 nt, Rattus norvegicus
cggccggcugggguuccuggggaugggauuugaugccagucacaaaucacauugccagggauuuccaacugaccc

SEQ ID NO: 4630 - RNA, 97 nt, Rattus norvegicus
cucaccugcucuggcugcuuggguuccuggcaugcugauuugugacuugagauuaaaaucacauugccagggauuaccacgcaaccaugaccuuggc

SEQ ID NO: 4631 - RNA, 68 nt, Rattus norvegicus; identical to SEQ ID NO: 3451

SEQ ID NO: 4632 - RNA, 108 nt, Rattus norvegicus
gccucucccugggcuccgccuccugugccuacugagcugaaacaguugauuccagugcacuggcucaguucagcaggaacaggaguccagcccccauaggagcuggca

SEQ ID NO: 4633 - RNA, 84 nt, Rattus norvegicus
ggccaguguugagaggcggagacacgggcaauugcuggacgcugcccugggcauugcacuugucucggucugacagugccggcc

SEQ ID NO: 4634 - RNA, 90 nt, Rattus norvegicus
aaggccguggccuuguucaaguaauccaggauaggcugugcaggucccaaggggccuauucuugguuacuugcacggggacgcgggccug

SEQ ID NO: 4635 - RNA, 85 nt, Rattus norvegicus
ugcccgggacccaguucaaguaauucaggauagguuguggugcuggccagccuguucuccauuacuuggcucgggggccggugcc

SEQ ID NO: 4636 - RNA, 87 nt, Rattus norvegicus
uggccuguggagcagggcuuagcugcuugugagcaaggucuacagcaaagucguguucacaguggcuaaguuccgcccccuggaccc

SEQ ID NO: 4637 - RNA, 97 nt, Rattus norvegicus; identical to SEQ ID NO: 159

SEQ ID NO: 4638 - RNA, 86 nt, Rattus norvegicus
ggucccuacccgcaaggagcucacagucuauugaguuccuuuucugauucucccacuagauugugagcuccuggagggcaggcacu

SEQ ID NO: 4639 - RNA, 88 nt, Rattus norvegicus; identical to SEQ ID NO: 3462

SEQ ID NO: 4640 - RNA, 81 nt, Rattus norvegicus
cuucaggaagcugguuucauauggugguuuagauuuaaauagugauugucuagcaccauuugaaaucaguguucuuggugg

SEQ ID NO: 4641 - RNA, 81 nt, Rattus norvegicus; identical to SEQ ID NO: 167

SEQ ID NO: 4642 - RNA, 88 nt, Rattus norvegicus; identical to SEQ ID NO: 168

SEQ ID NO: 4643 - RNA, 71 nt, Rattus norvegicus
gcaacuguaaacauccucgacuggaagcugugaagccacaaaugggcuuucagucggauguuugcagcugc

SEQ ID NO: 4644 - RNA, 87 nt, Rattus norvegicus
ccgaguuucaguucauguaaacauccuacacucagcugucauacaugaguuggcugggauguggauguuuacgucagcugucuugga

SEQ ID NO: 4645 - RNA, 89 nt, Rattus norvegicus; identical to SEQ ID NO: 3468

SEQ ID NO: 4646 - RNA, 84 nt, Rattus norvegicus
gagugacagauacuguaaacauccuacacucucagcugugaaaaguaagaaagcugggagaaggcuguuuacucucucugccuu

SEQ ID NO: 4647 - RNA, 82 nt, Rattus norvegicus; identical to SEQ ID NO: 3470

SEQ ID NO: 4648 - RNA, 92 nt, Rattus norvegicus; identical to SEQ ID NO: 3471

SEQ ID NO: 4649 - RNA, 106 nt, Rattus norvegicus
ugcuccugaaacuuggaacuggagaggaggcaagaugcuggcauagcuguugaacugagaaccugcuaugccaacauauugccaucuuuccugucugacagcagcu

SEQ ID NO: 4650 - RNA, 118 nt, Rattus norvegicus
uggccaagcugcugucagacaggaaagauggcaauauguuggcauagcagguucucaguucaacagcuaugccagcaucuugccuccucuccaguuccaaguuucaggagcaauacca

SEQ ID NO: 4651 - RNA, 70 nt, Rattus norvegicus
ggggauauugcacauuacuaaguugcauguugucacggccucaaugcaauuuagugugugugauauucuc

SEQ ID NO: 4652 - RNA, 69 nt, Rattus norvegicus
ccguggugcauuguaguugcauugcauguucuggcaguaccugugcaauguuuccacagugcaucacgg

SEQ ID NO: 4653 - RNA, 102 nt, Rattus norvegicus
ccggcugugaguaauucuuuggcagugucuuagcugguuguugugaguauuagcuaaggaagcaaucagcaaguauacugcccuagaagugcugcacguugu

SEQ ID NO: 4654 - RNA, 84 nt, Rattus norvegicus; identical to SEQ ID NO: 3477

SEQ ID NO: 4655 - RNA, 77 nt, Rattus norvegicus; identical to SEQ ID NO: 3478

SEQ ID NO: 4656 - RNA, 78 nt, Rattus norvegicus
cuuucuacacagguugggauuugucgcaaugcuguguuucuguauaguauugcacuugucccggccuguugaguuugg

SEQ ID NO: 4657 - RNA, 92 nt, Rattus norvegicus
ugcccauucauccacagguggggauuagugccauuacuuguguuagauaaaaaguauugcacuugucccggccugaggaagaaaagaggguu

SEQ ID NO: 4658 - RNA, 83 nt, Rattus norvegicus
ggugggcaggagggacgggacgcggugcaguguuguucuuuccccugccaauauugcacucgucccggccuccggcccccucg

SEQ ID NO: 4659 - RNA, 87 nt, Rattus norvegicus
agucaugggggcuccaaagugcuguucgugcagguagugcauugccugaccuacugcugagcuagcacuucccgagcccccaggaca

SEQ ID NO: 4660 - RNA, 106 nt, Rattus norvegicus
ccaguaccaucugcuuggccgauuuuggcacuagcacauuuuugcuugugucucuccgcucugagcaaucaugugcagugccaauaugggaaaagcgggcugcugc

SEQ ID NO: 4661 - RNA, 108 nt, Rattus norvegicus
cugcacaugcuggggugagguaguaaguuguauuguugugggguagggauuuuaggccccaauaagaagauaacuauacaacuuacuacuuucccugguguguggcau

SEQ ID NO: 4662 - RNA, 81 nt, Rattus norvegicus
cccauuggcauaaacccguagauccgaucuuguggugaaguggaccgcacaagcucguuucuaugggucuguggcagugug

SEQ ID NO: 4663 - RNA, 70 nt, Rattus norvegicus; identical to SEQ ID NO: 291

SEQ ID NO: 4664 - RNA, 80 nt, Rattus norvegicus
ccuguugccacaaacccguagauccgaacuugugcugaccaugcacacaagcuugugucuauagguaugugucuguuagg

SEQ ID NO: 4665 - RNA, 75 nt, Rattus norvegicus
ugcccuggcucaguuaucacagugcugaugcuguccauucuaaagguacaguacugugauaacugaaggauggca

SEQ ID NO: 4666 - RNA, 97 nt, Rattus norvegicus
aucugagacugaacuguccuuuuucgguuaucaugguaccgaugcuguagaucugaaagguacaguacugugauagcugaagaaugguggugccauc

SEQ ID NO: 4667 - RNA, 86 nt, Rattus norvegicus; identical to SEQ ID NO: 3491

SEQ ID NO: 4668 - RNA, 86 nt, Rattus norvegicus; identical to SEQ ID NO: 3492

SEQ ID NO: 4669 - RNA, 73 nt, Rattus norvegicus
uagucaagugcucagaugucugugguggcugcuuauguaucacggauguuugagcaugugcuaugguaucuac

SEQ ID NO: 4670 - RNA, 82 nt, Rattus norvegicus; identical to SEQ ID NO: 3495

SEQ ID NO: 4671 - RNA, 87 nt, Rattus norvegicus
uucucucugcuuuaagcuucuuuacaguguugccuuguggcauggaguucaagcagcauuguacagggcuaucaaagcacagagagc

SEQ ID NO: 4672 - RNA, 85 nt, Rattus norvegicus
ccuuagcagagcucuggagugugacaaugguguuuguguccaaaacaucaaacgccaucaucacacuaaacagcuacugcuaggc

SEQ ID NO: 4673 - RNA, 85 nt, Rattus norvegicus; identical to SEQ ID NO: 29

SEQ ID NO: 4674 - RNA, 109 nt, Rattus norvegicus; identical to SEQ ID NO: 3499

SEQ ID NO: 4675 - RNA, 87 nt, Rattus norvegicus; identical to SEQ ID NO: 31

SEQ ID NO: 4676 - RNA, 85 nt, Rattus norvegicus
ugccggccucugggucccugagacccuuuaaccugugaggacguccagggucacaggugagguucuugggagccuggcgccuggc

SEQ ID NO: 4677 - RNA, 87 nt, Rattus norvegicus
ugcgcuccccucagucccugagacccuaacuugugauguuuaccguuuaaauccacggguuaggcucuugggagcugcgagucgugc

SEQ ID NO: 4678 - RNA, 88 nt, Rattus norvegicus
accagacuuuuccuagucccugagacccuaacuugugagguauuuuaguaacaucacaagucaggcucuugggaccuaggcggagagg

SEQ ID NO: 4679 - RNA, 73 nt, Rattus norvegicus
ugacagcacauuauuacuuuugguacgcgcugugacacuucaaacucguaccgugaguaauaaugcgugguca

SEQ ID NO: 4680 - RNA, 118 nt, Rattus norvegicus
gcacucccggugcugcgcuguugaccacgcauuauuacucacgguacgaguuugaagugucacagcgcguaccaaaaguaauaaugugcugucaccggcaaagacacggcuccaggcu

SEQ ID NO: 4681 - RNA, 97 nt, Rattus norvegicus
uuugaucacugucuccagccugcugaagcucagagggcucugauucagaaagaucaucggauccgucugagcuuggcuggucggaagucucaucauc

SEQ ID NO: 4682 - RNA, 82 nt, Rattus norvegicus; identical to SEQ ID NO: 37

SEQ ID NO: 4683 - RNA, 84 nt, Rattus norvegicus
ugugcagugggaaggggggccgaugcacuguaagagagugaguagcaggucucacagugaaccggucucuuucccuacuguguc

SEQ ID NO: 4684 - RNA, 72 nt, Rattus norvegicus
ugggucuuuuugcggucugggcuugcuguucucuccacaguagucaggaagcccuuaccccaaaaaguaucu

SEQ ID NO: 4685 - RNA, 97 nt, Rattus norvegicus
agacugcccuucgcgaaucuuuuugcggucugggcuugcuguacauaacucaauagccggaagcccuuaccccaaaaagcauucgcggagggcgcgc

SEQ ID NO: 4686 - RNA, 88 nt, Rattus norvegicus
ugcugcuggccggagcucuuuucacauugugcuacugucuacacguguaccgagcagugcaauguuaaaagggcaucggccuuguagu

SEQ ID NO: 4687 - RNA, 82 nt, Rattus norvegicus
ggcuugcuggacacucuuucccuguugcacuacugugggccucugggaagcagugcaaugaugaaagggcauccgucaggcc

SEQ ID NO: 4688 - RNA, 101 nt, Rattus norvegicus
ccgcccccgcgucuccagggcaaccguggcuuucgauuguuacugugggaaccggagguaacagucuacagccauggucgccccgcagcacgcccacgcuc

SEQ ID NO: 4689 - RNA, 87 nt, Rattus norvegicus
caaugcuuugcuaaagcugguaaaauggaaccaaaucgccucuucaauggauuugguccccuucaaccagcuguagcuaugcauuga

SEQ ID NO: 4690 - RNA, 84 nt, Rattus norvegicus; identical to SEQ ID NO: 2841

SEQ ID NO: 4691 - RNA, 118 nt, Rattus norvegicus
gcuggcuguccuguggcaaucaaugcauagcuacagcugguugaaggggaccaaauccauugaagaggcgauuugguuccauuuuaccagcuuuagcaaagcauugccgcugcugguu

SEQ ID NO: 4692 - RNA, 73 nt, Rattus norvegicus
cagggugugugacugguugaccagaggggcgugcacuuuguucacccugugggccaccuagucaccaacccuc

SEQ ID NO: 4693 - RNA, 100 nt, Rattus norvegicus; identical to SEQ ID NO: 3522

SEQ ID NO: 4694 - RNA, 97 nt, Rattus norvegicus
cgcucugcuguggccuauggcuuuucauuccuaugugauugcuguuccgaacucauguagggcuaaaagccaugggcuacagugaggggcaagcucc

SEQ ID NO: 4695 - RNA, 82 nt, Rattus norvegicus
ugagcccucggaggacuccauuuguuuugaugauggauucuuaagcuccaucaucgucucaaaugagucuucagaggguucu

SEQ ID NO: 4696 - RNA, 102 nt, Rattus norvegicus
ggcccucugacucucuucggugacggguauucuuggguggauaauacggauuacguuguuauugcuuaagaauacgcguagucgaggagaguaccagcggca

SEQ ID NO: 4697 - RNA, 99 nt, Rattus norvegicus
cucuggcaugguguugugggacagcugguguugugaaucaggccguugccaaucagagaacggcuacuucacaacaccagggucucacugcacugcagg

SEQ ID NO: 4698 - RNA, 82 nt, Rattus norvegicus
guugcugcagcugguguugugaaucaggccgacgagcaacgcauccucuuacccggcuauuucacgacaccaggguugcacc

SEQ ID NO: 4699 - RNA, 68 nt, Rattus norvegicus; identical to SEQ ID NO: 55

SEQ ID NO: 4700 - RNA, 99 nt, Rattus norvegicus
gugucucucucuguguccugccagugguuuuacccuaugguagguuacaucaugcuguucuaccacaggguagaaccacggacaggauacuggagcacc

SEQ ID NO: 4701 - RNA, 94 nt, Rattus norvegicus
ggcugacucugaguccaucuuccagugcaguguuggaugguugaaguacgaagcuccuaacacugucugguaaagauggcccccgggucaguuc

SEQ ID NO: 4702 - RNA, 87 nt, Rattus norvegicus; identical to SEQ ID NO: 58

SEQ ID NO: 4703 - RNA, 105 nt, Rattus norvegicus
gcggagcgccugucucccagccugaggugcagugcugcaucucuggucaguugggagucugagaugaagcacuguagcucaggaagggagaagauguucugcagc

SEQ ID NO: 4704 - RNA, 83 nt, Rattus norvegicus
gggccuuggcugggauaucaucauauacuguaaguuugugaugagacacuacaguauagaugauguacuagucuggguacccc

SEQ ID NO: 4705 - RNA, 88 nt, Rattus norvegicus
caccuuguccucacgguccaguuuucccaggaaucccuuggaugcuaagauggggauuccuggaaauacuguucuugaggucauggcu

SEQ ID NO: 4706 - RNA, 95 nt, Rattus norvegicus
uguguauccucagcucugagaacugaauuccauggguuauagcaaugucagaccugugaaguucaguucuuuagcugggauagcucuaucgucau

SEQ ID NO: 4707 - RNA, 88 nt, Rattus norvegicus
uggccaccuggcccugagaacugaauuccauaggcugugaacucuagcagaugcccuagggacucaguucuggugccuggcugugcua

SEQ ID NO: 4708 - RNA, 79 nt, Rattus norvegicus
uaugaaucuaguggaaacacuucugcacaaacucgauuuugaugccagugugcggaaaugcuucugcuacauuuuuagg

SEQ ID NO: 4709 - RNA, 97 nt, Rattus norvegicus
caggcacucuuagcauuugaggugaaguucuguuauacacucaggcuguggcucugaaagucagugcaucacagaacuuugucucgaaagcuuucua

SEQ ID NO: 4710 - RNA, 85 nt, Rattus norvegicus
cuucucaaggcccugucucccaacccuuguaccagugcugugccucagacccugguacaggccugggggacagggacuuggggac

SEQ ID NO: 4711 - RNA, 97 nt, Rattus norvegicus
agcgcuuuccugcccucgaggagcucacagucuaguaugucuccucccuacuagacugaggcuccuugaggacagggaucgucauacucaccucccg

SEQ ID NO: 4712 - RNA, 85 nt, Rattus norvegicus
uguuccccgggcccagguucugugauacacuccgacucgggcucuggagcagucagugcaugacagaacuugggcccgguaggac

SEQ ID NO: 4713 - RNA, 87 nt, Rattus norvegicus; identical to SEQ ID NO: 74

SEQ ID NO: 4714 - RNA, 84 nt, Rattus norvegicus
gcggugcuugaagauagguuauccguguugccuucgcuuuauucgugacgaaucauacacgguugaccuauuuuucaguaccaa

SEQ ID NO: 4715 - RNA, 65 nt, Rattus norvegicus; identical to SEQ ID NO: 3548

SEQ ID NO: 4716 - RNA, 100 nt, Rattus norvegicus
agguugcuucagugaacauucaacgcugucggugaguuuggaauucaaauaaaaaccaucgaccguugauuguacccuauagcuaaccauuaucuacucc

SEQ ID NO: 4717 - RNA, 117 nt, Rattus norvegicus
agaugggcaaccaaggcagccuuaagaggacuccauggaacauucaacgcugucggugaguuugggauucaaaaacaaaaaaaaccaccaaccguugacuguaccuugggauucuua

SEQ ID NO: 4718 - RNA, 110 nt, Rattus norvegicus
ccugugcagagaugauguuuacaaaggucacaaucaacauucauugcugucgguggguugaacuguguagaaaagcucacugaacaaugaaugcaacuguggccccgcuu

SEQ ID NO: 4719 - RNA, 88 nt, Rattus norvegicus
ugauggcugcacucaacauucauugcugucgguggguuugaaugucaaccaacucacuggucaaugaaugcaaacugcgggccaaaaa

SEQ ID NO: 4720 - RNA, 106 nt, Rattus norvegicus
agaacuugccaaggguuugggggaacauucaaccugucggugaguuugggcagcucagacaaaccaucgaccguugaguggaccccgaggccuggaacugccaccc

SEQ ID NO: 4721 - RNA, 83 nt, Rattus norvegicus
ggucacaauuaacauucauuguugucgguggguugugaggagaagaccagacccaccgggggaugaaugucacuguggcuggg

SEQ ID NO: 4722 - RNA, 62 nt, Rattus norvegicus
acgcgggucuagcugccggaggccucccaccguuuuuggcaaugguagaacucacaccggua

SEQ ID NO: 4723 - RNA, 110 nt, Rattus norvegicus
ccagagagugugacuccuguccuguguauggcacugguagaauucacugugaacagucucggucagugaauuaccgaagggccauaaacagagcagagacagauccgcga

SEQ ID NO: 4724 - RNA, 77 nt, Rattus norvegicus
cacuuucccuuaucaguuuuccagccagcuuugugacuguaaauguuggacggagaacugauaaggguaagugacug

SEQ ID NO: 4725 - RNA, 80 nt, Rattus norvegicus
gggggugagggauuggagagaaaggcaguuccugaugguccccucccaggggcuggcuuuccucugguccuucucuccca

SEQ ID NO: 4726 - RNA, 86 nt, Rattus norvegicus
ugcuuacaacuuuccaaagaauucuccuuuugggcuuucucauuuuauuuuaagcccaaaggugaauuuuuugggaaguuugagcu

SEQ ID NO: 4727 - RNA, 104 nt, Rattus norvegicus
gggcucacaggacacaaugcggauccucaggcuacaacacaggacccgggcgcugcucugaccccucgugucuuguguugcagccggagggacgcaggucugca

SEQ ID NO: 4728 - RNA, 80 nt, Rattus norvegicus
cccucucucacaucccuugcaugguggagggcgagcucucugaaaacuccucccacaugcaggguuugcaggauggugag

SEQ ID NO: 4729 - RNA, 85 nt, Rattus norvegicus
ugcaggccucugugugauauguuugauauauuagguuguuauuuaauccaacuauauaucaagcauauuccuacagugucuugcc

SEQ ID NO: 4730 - RNA, 78 nt, Rattus norvegicus
ugcuucugugugauauguuugauauuagguuguuaaauuaugaaccaacuaaaugucaaacauucucacagcagugag

SEQ ID NO: 4731 - RNA, 91 nt, Rattus norvegicus
ggcuggacagcgggcaacggaaucccaaaagcagcuguugucuccagagcauuccagcugcacuuggauuucguucccugcucuccugccu

SEQ ID NO: 4732 - RNA, 120 nt, Rattus norvegicus
cagggcgcugcucaggcaggagagcagggaacgaaauccaagugcagcuggaaugcucuggagacaacagcugcuuuugggauuccguugcccgcuguccagccauuggaggagggcucu

SEQ ID NO: 4733 - RNA, 110 nt, Rattus norvegicus
gucaagauggagugcacagggcucugaccuaugaauugacagccaguacucugaucucgccucuggcugccaguuccauaggucacagguauguucgccucaaugccagc

SEQ ID NO: 4734 - RNA, 86 nt, Rattus norvegicus
gcggacgggagcugagagcugggucuuugcgggcaagaugagggugucaguucaacuggccuacaaagucccaguccucggcuccc

SEQ ID NO: 4735 - RNA, 83 nt, Rattus norvegicus
auggagucaucacguguaacagcaacuccauguggacugugcacagaucccaguggagcugcuguuacuuuugauggccucca

SEQ ID NO: 4736 - RNA, 85 nt, Rattus norvegicus
uggcucccacccccuguaacagcaacuccauguggaagugcccacugauuccaguggggcugcuguuaucugggguggaggcugg

SEQ ID NO: 4737 - RNA, 87 nt, Rattus norvegicus
aacucuccuggcucuagcagcacagaaauauuggcacggguaagugagucugccaauauuggcugugcugcuccaggcaggguggug

SEQ ID NO: 4738 - RNA, 110 nt, Rattus norvegicus
uguuugcucagcugaucuguggcuuagguaguuucauguuguugggauugaguuuugaacucggcaacaagaaacugccugaguuacaucagucgguuuucgucgagggc

SEQ ID NO: 4739 - RNA, 85 nt, Rattus norvegicus; identical to SEQ ID NO: 3574

SEQ ID NO: 4740 - RNA, 80 nt, Rattus norvegicus
cugagugaaguagguaguuucguguuguugggccuggcuuucugaacacaacaacaccaaaccaccugauucacugcagu

SEQ ID NO: 4741 - RNA, 110 nt, Rattus norvegicus
uggaagcuucuggagauccugcuccgucgccccaguguucagacuaccuguucaggacaaugccguuguacaguagucugcacauugguuagacugggcaagggccagca

SEQ ID NO: 4742 - RNA, 89 nt, Rattus norvegicus
cugggccucugugggcaucuuaccggacagugcuggauuucuuggcuugacucuaacacugucugguaacgauguucaaaggugaccca

SEQ ID NO: 4743 - RNA, 95 nt, Rattus norvegicus
ccaacuugggcagccguggccaucuuacugggcagcauuggauagugucugaucucuaauacugccugguaaugaugacggcggagcccugcacg

SEQ ID NO: 4744 - RNA, 69 nt, Rattus norvegicus; identical to SEQ ID NO: 3580

SEQ ID NO: 4745 - RNA, 80 nt, Rattus norvegicus
guacaguaccucacucaguaaggcauuguucuucuauacuaauaaaugaacagcgccuuucuguguagcguaaugugcaa

SEQ ID NO: 4746 - RNA, 72 nt, Rattus norvegicus
guuccuuuuuccuaugcauauacuucuuuguggaucuggucuaaagagguauagcgcaugggaaaauggagc

SEQ ID NO: 4747 - RNA, 97 nt, Rattus norvegicus
gcgcgccugguccagugguucuuaacaguucaacaguucuguagcgcaauugugaaauguuuaggaccacuagacccggcgcgcacggcagcggcga

SEQ ID NO: 4748 - RNA, 115 nt, Rattus norvegicus
gcugucgccgcugccgugcgcgccgggucuagugguccuaaacauuucacaauugcgcuacagaacuguugaacuguuaagaaccacuggaccaggcgcgccugcacacagaagc

SEQ ID NO: 4749 - RNA, 110 nt, Rattus norvegicus
ggcuacagcccuucuucaugugacucguggacuucccuuugucauccuaugccugagaauauaugaaggaggcugggaaggcaaagggacguucaauugucaucacuggc

SEQ ID NO: 4750 - RNA, 108 nt, Rattus norvegicus
aaacagccccagacaauccauggguccuccuguccuucauuccaccggagucugucuuaugccaaccagauuucaguggagugaagcucaggaggcauggagcugcca

SEQ ID NO: 4751 - RNA, 84 nt, Rattus norvegicus
cuuccccaggccacaugcuucuuuauauccucauagauaucacugcgcuauggaauguaaggaagugugugguuuuggcaagug

SEQ ID NO: 4752 - RNA, 78 nt, Rattus norvegicus
aggcaggggugaggggcugcgggaggagcggggcggaggcugcggcuugcgcuucuccuggcucuccucccuuucuuu

SEQ ID NO: 4753 - RNA, 83 nt, Rattus norvegicus
uuccuuugacgggugagcuuuuggcccggguuauaccugacucucacguauaagacgagcaaaaagcuuguuggucagaggag

SEQ ID NO: 4754 - RNA, 112 nt, Rattus norvegicus
acccccaccuccugcuccucucagggaagcuuuuugcucgcguuauguuucucauccgaauauaagacgaacaaaagguuugucugagggcugagugcacccaccuggggua

SEQ ID NO: 4755 - RNA, 110 nt, Rattus norvegicus
ccggggcagucccuccaggcucaggacagccacugcccacagcacacugcguugcuccggacccacugugcgugugacagcggcugaucugucccugggcagcgcgaacc

SEQ ID NO: 4756 - RNA, 106 nt, Rattus norvegicus
cagcuuggaccugugaccucugggcuucccuuugucauccuuugccuaggccucugaguggggcaaggacagcaaaggggggcucaguggucaccucuacugcaga

SEQ ID NO: 4757 - RNA, 111 nt, Rattus norvegicus
cgggauauccccgcccgggcagcgcgccggcaccuuggcucuagacugcuuacugcccgggccgcccucaguaacagucuccagucacggccaccgacgccuggccccgcc

SEQ ID NO: 4758 - RNA, 110 nt, Rattus norvegicus
guccuggauggacagaguugucaugugucugccugucuacacuugcugugcagaacauccgcucaccuguacagcaggcacagacaggcagucacaugacaacccagccu

SEQ ID NO: 4759 - RNA, 97 nt, Rattus norvegicus
gguguacaggacaaugaccuaugauuugacagacaguguggcugcgugugucugucauucuguaggccaauauucuguaugucucuccuccuuacaa

SEQ ID NO: 4760 - RNA, 106 nt, Rattus norvegicus
guuagcuaugaguuaguuuaaucucagcuggcaacugugagaugucccuaucauuccucacaguggucucugggauuaugcuaaacagagcaauuuccuugaccuc

SEQ ID NO: 4761 - RNA, 102 nt, Rattus norvegicus
ugcacguuggcagacugggaaaucucugcaggcaaaugugaugucacugaagaaaucacacacuuacuuguagagauucuucagucugacaacaucaagcau

SEQ ID NO: 4762 - RNA, 105 nt, Rattus norvegicus
accacagucauuguaguuuugaugucgcagauacugcaucaggaacugacuggauaagacucagucaccaucaguuccuaaugcauugccuucagcaucuaaaca

SEQ ID NO: 4763 - RNA, 110 nt, Rattus norvegicus
gugauaacguagcgagauuuucuguugugcuugaucuaaccaugugcuugcgagguaugaguaaaacaugguuccgucaagcaccauggaacgucacgcagcuuucuaca

SEQ ID NO: 4764 - RNA, 110 nt, Rattus norvegicus; identical to SEQ ID NO: 3600

SEQ ID NO: 4765 - RNA, 114 nt, Rattus norvegicus
uguagaaagcugcgugacguuccauggugcuugacggaaccauguuuuacucauaccucgcaagcacaugguuagaucaagcacaacagaaaaucucgcuacguuaucacuaca

SEQ ID NO: 4766 - RNA, 110 nt, Rattus norvegicus
cugucccgggccgcggcuccugauuguccaaacgcaauucucgagucucuggcuccggccgagaguugcgucuggacgucccgagccgccgcccccaaaccucgaggggg

SEQ ID NO: 4767 - RNA, 96 nt, Rattus norvegicus
acucaggggcuucaccacugauuguccaaacgcaauucuuguacgagucugcggccaaccgagaauuguggcuggacaucugugguugagcuccgg

SEQ ID NO: 4768 - RNA, 100 nt, Rattus norvegicus
agaccggagcucaaccacagauguccagccacaauucucgguuggccgcagacucguacaagaauugcguuuggacaaucaguggugaagccccugaguu

SEQ ID NO: 4769 - RNA, 109 nt, Rattus norvegicus
ugaauauccaggucuggggcaugaaccuggcauacaauguagauuucuguguuuguuaggcaacagcuacauugucugcuggguuucaggcuaccuggaagcauuucuc

SEQ ID NO: 4770 - RNA, 103 nt, Rattus norvegicus
aaggauuagggugcccucaguggcucaguagccaguguagauccugucuuugguaaucagcagcuacaucuggcuacugggucucugauggcaucaucuagcu

SEQ ID NO: 4771 - RNA, 110 nt, Rattus norvegicus
ucuggccuucugcaguguuacgcuccguguauuugacaagcugaguuggacacucugugugguagagugucaguuugucaaauaccccaaguguggcucaugcuuaucag

SEQ ID NO: 4772 - RNA, 82 nt, Rattus norvegicus
gggcuuucaagucacuagugguuccguuuaguagaugguuuuugcauuguuucaaaauggugcccuagugacuacaaagccc

SEQ ID NO: 4773 - RNA, 81 nt, Rattus norvegicus
ucaucuugcgguucucaaacuaugggggcacuuuuuuuuucuuuaaaaagugccgccagguuuuagggccugccgguugag

SEQ ID NO: 4774 - RNA, 82 nt, Rattus norvegicus
ccgguguaguagccaucaaaguggaggcccucucuugggcccgagcuagaaagugcuuccacuuugugugccacugcauggg

SEQ ID NO: 4775 - RNA, 108 nt, Rattus norvegicus
cggaucuuggaaguuggaacacaggguccaucaaaguggaggcccucuccguggcuuggcgggaaagugcauccauuuuguuagucucugugucccgcuggacucacc

SEQ ID NO: 4776 - RNA, 82 nt, Rattus norvegicus
caaccugugauacucaaacugggggcucuuuuggguuuucuuuggaagaaaagugccgccagguuuugaguguuaccgauug

SEQ ID NO: 4777 - RNA, 72 nt, Rattus norvegicus
cugugauacucaaacugugugacacuuuguuucuuuuggaagaagugccgcaaaguuugcaguguuaccgau

SEQ ID NO: 4778 - RNA, 71 nt, Rattus norvegicus
auagccaugcucaaaauggaggcccuaucuaagcuuuuaaguagaaagugcuuccauuuuguguguugcug

SEQ ID NO: 4779 - RNA, 81 nt, Rattus norvegicus
cauuuuggugagacucaaauguggggcacacuucuggauuaugcguagaaagugcuacuacuuuugggugucuccuguggg

SEQ ID NO: 4780 - RNA, 81 nt, Rattus norvegicus; identical to SEQ ID NO: 4779

SEQ ID NO: 4781 - RNA, 78 nt, Rattus norvegicus
ggaccuuucuggagggcccccccucaauccuguugugcucgcuucagaggguuggguggaggcucuccugaagguguc

SEQ ID NO: 4782 - RNA, 66 nt, Rattus norvegicus
augcauguaugugugcauguaugcaugcaugcauguauguauguauggugcacuugugugugugug

SEQ ID NO: 4783 - RNA, 82 nt, Rattus norvegicus
ccaggccuucggcagaggagggcuguucuucccuuggguuuuaugacugggaggaacuagccuucucucugcuuaggagugg

SEQ ID NO: 4784 - RNA, 63 nt, Rattus norvegicus; identical to SEQ ID NO: 2924

SEQ ID NO: 4785 - RNA, 118 nt, Rattus norvegicus
cggacuggauggcugggcuggauaccaagaagcgguuuaccgucccacauacauacucaaaauguaugugggacgguaaaccauuucuucaaguaccgcgugacagcagggacagcug

SEQ ID NO: 4786 - RNA, 79 nt, Rattus norvegicus; identical to SEQ ID NO: 3628

SEQ ID NO: 4787 - RNA, 100 nt, Rattus norvegicus
ccugcuggcuacugcugacgacugcucugacuuuauugcacuacuguacuguacagcuagcagugcaauaguauugucaaagcauccgggagcaggcuac

SEQ ID NO: 4788 - RNA, 78 nt, Rattus norvegicus
gcugcgggugcucugacuagguugcacuacugugcuguggaaagcagugcaaugguauugucaaagcaucugggacca

SEQ ID NO: 4789 - RNA, 82 nt, Rattus norvegicus
gccucgcuguccuccgccuucucuucccgguucuucccggagucgggaaaagcuggguugagagggcgaaaaaggauauggg

SEQ ID NO: 4790 - RNA, 95 nt, Rattus norvegicus
ccucgcugacuccgaagggaugcagcagcaauucauguuuuggaguauugccaagguucaaaacaugaagcgcugcaacaccccuucgugggaaa

SEQ ID NO: 4791 - RNA, 86 nt, Rattus norvegicus; identical to SEQ ID NO: 3637

SEQ ID NO: 4792 - RNA, 83 nt, Rattus norvegicus
cugacuaugccuccucgcauccccuagggcauugguguaaagcuggagacccacugccccaggugcugcuggggguuguaguc

SEQ ID NO: 4793 - RNA, 98 nt, Rattus norvegicus; identical to SEQ ID NO: 3639

SEQ ID NO: 4794 - RNA, 95 nt, Rattus norvegicus
cucaucugucuguggggcugggggcagggccuuugugaaggcggguuaugcucagaucgccucugggcccuuccuccagucccgaggcagauuua

SEQ ID NO: 4795 - RNA, 94 nt, Rattus norvegicus
gucugaugcccucauccuugaggggcaugaggguagucaguagccugaugucccucuugauggcacuucggacauguuggaauggcuugugagg

SEQ ID NO: 4796 - RNA, 84 nt, Rattus norvegicus
uggggcaggggggcaggaggggcucagggagaaagcaucuacagccccuggcccucucugcccuuccguccccuguccccaaau

SEQ ID NO: 4797 - RNA, 118 nt, Rattus norvegicus
ggaggagggggagggagggaaggggcgagggaggggcuagaagguagucggcagaugcaaccauuaggcuggcuggcccucucugcccuaccccccaccucacuaacccguggccucc

SEQ ID NO: 4798 - RNA, 97 nt, Rattus norvegicus; identical to SEQ ID NO: 3643

SEQ ID NO: 4799 - RNA, 97 nt, Rattus norvegicus
acccuuuggcgaucucugccucucugggccugugucuuaggcucuucaagaucuaacgagcaaagcacagggccugcagagagguagcgcucugcuc

SEQ ID NO: 4800 - RNA, 96 nt, Rattus norvegicus
gagucuggucuuguuuggguuuguucuagguauggucccagggaucccagaucaaaccaggccccugggccuauccuagaaccaaccuaaacccau

SEQ ID NO: 4801 - RNA, 98 nt, Rattus norvegicus
ucuuuugggcgggggucaagagcaauaacgaaaaauguuuguuuuucguaaaccguuuuucauuauugcuccugaccuccucucauuuguuauagcca

SEQ ID NO: 4802 - RNA, 96 nt, Rattus norvegicus
augugaccgugccucucacccuuccauaucuagucucugagaaaaaugaagacuggauuccaugaagggaugugaggccuggaaacuggagcuuua

SEQ ID NO: 4803 - RNA, 97 nt, Rattus norvegicus
aguguagugagaaguuggggggugggaacggcgucaugcaggaguugauugcacagccauucagcuccuauaugaugccuuucuucacccccuucaa

SEQ ID NO: 4804 - RNA, 66 nt, Rattus norvegicus
uccccaacaauauccuggugcugagugggugcacagugacuccagcaucagugauuuuguugaaga

SEQ ID NO: 4805 - RNA, 96 nt, Rattus norvegicus
acgggguggacaccgucccuguccuccaggagcucacguaugccugccugugagcgccucgacgacagagccagaguccaccccugcacugcccaa

SEQ ID NO: 4806 - RNA, 98 nt, Rattus norvegicus
cacuuguacucggugugauuauaaagcaaugagacugauugucaugugucguuugugggauccgucucaguuacuuuauagccauaccugguaucuua

SEQ ID NO: 4807 - RNA, 96 nt, Rattus norvegicus; identical to SEQ ID NO: 3651

SEQ ID NO: 4808 - RNA, 99 nt, Rattus norvegicus; identical to SEQ ID NO: 3652

SEQ ID NO: 4809 - RNA, 93 nt, Rattus norvegicus
gcaccuucauggaccuggaguagaguggguguggcggggggagcagggcccagggcaaccucucccuccgugugcccagauccugcaugccaa

SEQ ID NO: 4810 - RNA, 98 nt, Rattus norvegicus
cugcagccagaguuuuuaccagucaggcuccuggcuagauuccagguaccaacugguaccugaucuagccaaagccugaccguaagcugcaaaagaaa

SEQ ID NO: 4811 - RNA, 107 nt, Rattus norvegicus
gcagccaggguuuuuaccagucaggcuccuggcuagauuccagguaccaacugguaccugaucuagccaaagccugacuguaagcuguaaaaacaaaggaagacugc

SEQ ID NO: 4812 - RNA, 98 nt, Rattus norvegicus
agagaccugaucagucaggcugcugguuauauuccaggacuucucugguccuggauauaaccaaagcccgacuguuaaauaaaaguaagaaugugucu

SEQ ID NO: 4813 - RNA, 71 nt, Rattus norvegicus
ugaucagucaggcugcugguuauauuccaggacuucucugguccuggguauaaccaaagcccgacuguuaa

SEQ ID NO: 4814 - RNA, 79 nt, Rattus norvegicus
aauuucugucagucaggcuccuggcaggaguccagcucucagcugguuccaggcucuagccaggggcuugacugcaagc

SEQ ID NO: 4815 - RNA, 99 nt, Rattus norvegicus
acagggcuuuugcaagucaggcuccuggcuggaguccagcucuaagcuggauccaggcucuagccagggcuugacugcacucugcucaauagagaaggg

SEQ ID NO: 4816 - RNA, 96 nt, Rattus norvegicus; identical to SEQ ID NO: 3667

SEQ ID NO: 4817 - RNA, 98 nt, Rattus norvegicus
ucuguguugggcaucugucugccugagugccugccucucuguugcucugaaggaggcaggggcugggccugcagcugccugggcagagcugcuccuuc

SEQ ID NO: 4818 - RNA, 92 nt, Rattus norvegicus
gagccccugcuggugggcgcggggcggggguuucagguggucucgcgguggccgcccgacugucccucugggucgcccagcuggggaguucc

SEQ ID NO: 4819 - RNA, 97 nt, Rattus norvegicus
gaagacucuagcauguaagguugggggagggggcugugucuagcaagucuucuucccccacagcccugcugucuuaaccucuagguguuccggcucc

SEQ ID NO: 4820 - RNA, 99 nt, Rattus norvegicus
agaugccuugcuccuacaagaguaaagugcacgugcuuugggacagugaggaaaauaauguucacaaagcccauacacuuucacccuuuaggagaguug

SEQ ID NO: 4821 - RNA, 81 nt, Rattus norvegicus
cauggcaccuccauuucccugaggagcccuuugagccugaggugaaaaaaaaacaggucaagaggcgccugggaacuggag

SEQ ID NO: 4822 - RNA, 96 nt, Rattus norvegicus
guacauauguugaagauuauuaauauauagaguggguguuguggugguaguaugauauguagaguaguagguugcauaguacgauguaguguauga

SEQ ID NO: 4823 - RNA, 70 nt, Rattus norvegicus
gaagcuuaucagaaucuccagggguacuuauuauuugaaaagucccccaggugugauucugauucguuuc

SEQ ID NO: 4824 - RNA, 65 nt, Rattus norvegicus; identical to SEQ ID NO: 3672

SEQ ID NO: 4825 - RNA, 87 nt, Rattus norvegicus
uuuugcuguuaucggguggaucacgaugcaauuuugauuagaguaaugggagagaaauugcacgguauccaucuguaaaccgcagga

SEQ ID NO: 4826 - RNA, 86 nt, Rattus norvegicus
acagcaagaaaaaugagggacuuucaggggcagcuguguuuccugacucagucauaaugccccuaaaaauccuuauuguucuugca

SEQ ID NO: 4827 - RNA, 79 nt, Rattus norvegicus
gguacuugaagggagaucgaccguguuauauucgcuuagcugacuucgaauaauacaugguugaucuuuucucaguauc

SEQ ID NO: 4828 - RNA, 79 nt, Rattus norvegicus
agacagagagaccaggucacgucucugcaguuacacagcucaugagugccugcugggguggaaccugguuugucugucu

SEQ ID NO: 4829 - RNA, 68 nt, Rattus norvegicus
cucggauggauauaauacaaccugcuaaguguucuagcacuuagcacguuguauuauuauuguccgag

SEQ ID NO: 4830 - RNA, 75 nt, Rattus norvegicus
uccggccccgcgacgagccccucgcacaaaccggaccugagcguuuuguucguucggcucgcgugaggcaggggc

SEQ ID NO: 4831 - RNA, 82 nt, Rattus norvegicus
ugauauuuaaaagguagauucuccuucuaugaguacaauauuaaugacuaaucguagaggaaaauccacguuuucaguauca

SEQ ID NO: 4832 - RNA, 86 nt, Rattus norvegicus
uuugguauuuaaaagguggauauuccuucuaugguuacgugcuuccuggauaaucauagaggaacauccacuuuuucaguaucaaa

SEQ ID NO: 4833 - RNA, 84 nt, Rattus norvegicus
uugguauuuaaaagguggauauuccuucuauguuuaugguauuuaugauuaaacauagaggaaauuucacguuuucagugucaa

SEQ ID NO: 4834 - RNA, 72 nt, Rattus norvegicus
cuugagcagagguugcccuuggugaauucgcuuuauugauguugaaucacacaaaggcaacuuuugguugag

SEQ ID NO: 4835 - RNA, 65 nt, Rattus norvegicus
gggcuccugacuccagguccuguguguuaccucgaaauagcacuggacuuggagucagaaggccu

SEQ ID NO: 4836 - RNA, 84 nt, Rattus norvegicus
aggagaacaguggacuuggagucagaaggucuguguggaacugggccuccgacauggacuaucacugaccaugauuccauuccg

SEQ ID NO: 4837 - RNA, 85 nt, Rattus norvegicus
ugguuccugcagaggugguagacuauggaacguaggcguuauguuucugaccuauguaacaugguccacuaacucucaguaucca

SEQ ID NO: 4838 - RNA, 77 nt, Rattus norvegicus
accugaaaagaugguugaccauagaacaugcgcuacuucugugucguauguaguaugguccacaucuucucauuauc

SEQ ID NO: 4839 - RNA, 61 nt, Rattus norvegicus
agcgagguugcccuuuguauauucgguuuauugacaugggauauacaagggcaagcucucu

SEQ ID NO: 4840 - RNA, 80 nt, Rattus norvegicus
gguacuugaagagaaguuguucgugguggauucgcuuuacuugugacgaaucauucacggacaacacuuuuuucaguacc

SEQ ID NO: 4841 - RNA, 74 nt, Rattus norvegicus
uccucagaucagaaggugacuguggcuuuggguggauauuaaucagccacagcacugccuggucagaaagagca

SEQ ID NO: 4842 - RNA, 83 nt, Rattus norvegicus
aaucaggaauuguaaacaauuccuaggcaauguguauaauguugguaagucauuccuagaaauuguucacaaugccuguaaca

SEQ ID NO: 4843 - RNA, 77 nt, Rattus norvegicus
gguacucggagagagguuacccgagcaacuuugcaucuggaggacgaauguugcucggugaaccccuuuucgguauc

SEQ ID NO: 4844 - RNA, 80 nt, Rattus norvegicus
uugauaccgaaaagggguucaccgagcaacauucguccuccagaugcaaaguugcucggguaaccucucuccgaguacca

SEQ ID NO: 4845 - RNA, 76 nt, Rattus norvegicus
acuugaggagagguugucugugaugaguucgcuuuauuaaugacgaauauaacacagauggccuguuuucaauacc

SEQ ID NO: 4846 - RNA, 76 nt, Rattus norvegicus
cuuggagagauaguagaccguauagcguacgcuuuaucugugacguauguaacacgguccacuaacccucaguauc

SEQ ID NO: 4847 - RNA, 70 nt, Rattus norvegicus
gggacggauggucgaccagcuggaaaguaauuguuucuaauguacuucaccugguccacuagccgucggu

SEQ ID NO: 4848 - RNA, 79 nt, Rattus norvegicus
cacacuguaggccucauuaaauguuuguugaaugaaaaaaugaaucaucaacagacauuaauugggcgccugcucugug

SEQ ID NO: 4849 - RNA, 79 nt, Rattus norvegicus
gaaguuaggcugaggggcagagagcgagacuuuucuauuuuccaaaagcucggucugaggccccucagucuugcuuccu

SEQ ID NO: 4850 - RNA, 83 nt, Rattus norvegicus
agugcuuuggaaugacacgaucacucccguugagugggcacccaagaagccaucgggaauaucguguccgcccagugcucuuu

SEQ ID NO: 4851 - RNA, 85 nt, Rattus norvegicus
ugccugcugauggaugucuuaccagacaugguuagaucuggauguaucugucuaauacugucugguaaugccguccauccauggc

SEQ ID NO: 4852 - RNA, 114 nt, Rattus norvegicus
uccugcgcguccugcgaggugucuugcaggccgucaugcaggccacacugacgguaacguugcaggucgucuugcagggcuucucgcaagacgacaucuucaucgccaacgacg

SEQ ID NO: 4853 - RNA, 93 nt, Rattus norvegicus; identical to SEQ ID NO: 267

SEQ ID NO: 4854 - RNA, 81 nt, Rattus norvegicus
guuugaaccacagcucgacucaugguuugaaccauugucaaacucgugguuugaaccaucacucgacuccugguuugaauc

SEQ ID NO: 4855 - RNA, 112 nt, Rattus norvegicus
acggggagguugaacauccugcauagugcugccaggaaaucccuacuucauacuaagagggggcuggcugguugcauauguaggaugucccaucucccggcccacuucguca

SEQ ID NO: 4856 - RNA, 91 nt, Rattus norvegicus
cugugugcgauggguuggcaguguauuguuagcugguugaguauguaaaaggcaccagcuaacaugcaacugcucuccuauugcacauaca

SEQ ID NO: 4857 - RNA, 99 nt, Rattus norvegicus
aagcgugggugugucagacaggcagugcauugcuagcuggcuguuagaacuucgucccaacaguggcuagcugcacuacccucugcugcacuuagaagc

SEQ ID NO: 4858 - RNA, 91 nt, Rattus norvegicus
gagagaugcggagcuguuuuugcgauguguuccuaaugugugcuacaauuauauugggaacauuuugcauaaauaguuuuacaucgacaca

SEQ ID NO: 4859 - RNA, 72 nt, Rattus norvegicus
uuugggaauggcgaggaaaccguuaccauuacugaguuuaguaaugguaaugguucucuugcugcucccaca

SEQ ID NO: 4860 - RNA, 78 nt, Rattus norvegicus
ggugugagcguaugugccuuuggacuacaucguggacgcagcaccaugcaguccacgggcauauacacuugccucaag

SEQ ID NO: 4861 - RNA, 78 nt, Rattus norvegicus
acccuguuuuaccuaauuuguuguccaucauguaaaauuuaagugaugauagacgccaauuuggguagaggaaggcuc

SEQ ID NO: 4862 - RNA, 77 nt, Rattus norvegicus
ugcagugcccuauuuagaacggugcuggugugaugaaugaaguuugaucagugccuuucugaguagaguaaggcuua

SEQ ID NO: 4863 - RNA, 86 nt, Rattus norvegicus
cauguguauauauguguguguguauguccauguguguauaugaauauacauacacacacacauacacacacgugcaagcacacaca

SEQ ID NO: 4864 - RNA, 82 nt, Rattus norvegicus
cauguguguauauguguguguguauguccauguguguauaugauuauacauauacauacacacauacacauauacgcaagca

SEQ ID NO: 4865 - RNA, 79 nt, Rattus norvegicus
ccuguguguaugugaugugugcauguacauguguguauauggagaaacauauacaugcacacauacacacacacaggca

SEQ ID NO: 4866 - RNA, 93 nt, Rattus norvegicus
ugugcauaugacuauauguguguguauguucuuuuguguauaugaauauacauauacauaaacacauacacacacaaacaagaacacucacac

SEQ ID NO: 4867 - RNA, 78 nt, Rattus norvegicus
agcagugcuuuacguaguauagugcuuuucacauuacacaaaaagugaaaggugccauacuauguacaggaaggcuua

SEQ ID NO: 4868 - RNA, 73 nt, Rattus norvegicus; identical to SEQ ID NO: 3775

SEQ ID NO: 4869 - RNA, 77 nt, Rattus norvegicus
gcaugcagggaagggggggcggggccucgcggcccugcugccucgucaggcucaguccccucccgauaaaccucaaa

SEQ ID NO: 4870 - RNA, 79 nt, Rattus norvegicus
gauacuuggagagaggcuggccgugaugaauucgauucaucuaaacgagucauacacggcucuccucucuucuaguguc

SEQ ID NO: 4871 - RNA, 82 nt, Rattus norvegicus
ugguacuuggagagugguuaucccuguccucuucgcuucacuuaugccgaaucguacagggucauccacuuuuucaguauca

SEQ ID NO: 4872 - RNA, 79 nt, Rattus norvegicus
aauccucucucccagauaauggcacucucaaacaaguuucuacauuguuugaaaggcuguuucuuggucagaagacucu

SEQ ID NO: 4873 - RNA, 106 nt, Rattus norvegicus
acugcuacaguggcagcuugguugucguaugcgugaugacacguucucguguauuccagaaugacaucacauauauggcagcuaaacuguuacaggaacaacaagu

SEQ ID NO: 4874 - RNA, 84 nt, Rattus norvegicus; identical to SEQ ID NO: 3782

SEQ ID NO: 4875 - RNA, 84 nt, Rattus norvegicus
ggccuccagggccuuguacaugguaggcuuucauucauuguuugcacauucggugaaggucuacugugugccaggcccugugcc

SEQ ID NO: 4876 - RNA, 83 nt, Rattus norvegicus
ugauacuugaaggagagguuguccguguugucuucucuuuauuuaugaugaaacauacacgggaaaccucuuuuuuaguauca

SEQ ID NO: 4877 - RNA, 80 nt, Rattus norvegicus
uaccugaaaagaaguugcccauguuauuuuucgcuuuuauuugugacgaaacaaacauggugcacuucuuuuucgauauc

SEQ ID NO: 4878 - RNA, 79 nt, Rattus norvegicus
aguguucgaauggagguuguccaugguguguucauuuuauuuaugaugaguauuacauggccaaucuccuuucggcacu

SEQ ID NO: 4879 - RNA, 69 nt, Rattus norvegicus
ccagcagcacacugugguuuguacggcacuguggccacguccaaaccacacugugguguuagagcgagg

SEQ ID NO: 4880 - RNA, 65 nt, Rattus norvegicus
gcuguuaagacuugcagugauguuuagcuccucuccaugugaacaucacagcaagucugugcugc

SEQ ID NO: 4881 - RNA, 80 nt, Rattus norvegicus
cccccucucuaauccuugcuaucugggugcuuagugcuaucucaaugcaaugcaccugggcaaggguucagagaagguga

SEQ ID NO: 4882 - RNA, 84 nt, Rattus norvegicus
gcucguccucucuaauccuuugucccugggugaaaaugcuauuuguaugcaaugcacccgggcaaggauuuggggaagguaagc

SEQ ID NO: 4883 - RNA, 71 nt, Rattus norvegicus
ugcccuagcagcgggaacaguacugcagugaguguuuggugcccuggaguauuguuuccgcugccugggua

SEQ ID NO: 4884 - RNA, 77 nt, Rattus norvegicus
cuguugggagacccuggucugcacucugucuggaaacuuacagaagggagagcagggcaggguuucccauacagagg

SEQ ID NO: 4885 - RNA, 67 nt, Rattus norvegicus
agugggggagccaggaaguauugauguuucugccagguuagcgucaacacuugcugguuuccucucu

SEQ ID NO: 4886 - RNA, 85 nt, Rattus norvegicus
cugugugugguucuuuacuccagaauauggcaaucaugcauaauuaaaugugauugacaugucugcaguggaguaacacaugcaa

SEQ ID NO: 4887 - RNA, 79 nt, Rattus norvegicus
gauacccaccaugccuuuugcucugcacucaguacauaaucauuugugaauguguagcaaaagacaggauggggaucca

SEQ ID NO: 4888 - RNA, 79 nt, Rattus norvegicus
uuuucucuuccaugccuugaguguaggacuguugacaucuuaauuacccucccacacccaaggcuugcaggagagcaag

SEQ ID NO: 4889 - RNA, 76 nt, Rattus norvegicus
auacuugaggagaaauuauccuugguguguuugcucuuuuggaugaaucauacaaggguaauuucuuuucgaguau

SEQ ID NO: 4890 - RNA, 84 nt, Rattus norvegicus
cccuggggcugggccaagggucacccucugacucuguggccaaggguagacaggucagaggucgauccugggccuacucugggg

SEQ ID NO: 4891 - RNA, 90 nt, Rattus norvegicus
gccaaaaucagagaagggauucugauguuggucacacuccaagaauuuuaaaaugaguggcgaacacagaauccauacucugcuuauggc

SEQ ID NO: 4892 - RNA, 79 nt, Rattus norvegicus
ucucagacgucucggggaucaucaugucacgagauaccacugcgcacuugugacagauugauaacugaaaggucuggga

SEQ ID NO: 4893 - RNA, 80 nt, Rattus norvegicus
ggugcuuaaugagaaguugcccgcguguuuuucgcuuuauaugugacgaaacauucgcggugcacuucuuuuucagcauc

SEQ ID NO: 4894 - RNA, 78 nt, Rattus norvegicus
caccuagggaucuuguuaaaaagcagauucugauugagggaccaagauucugcauuuuuagcaagcucucaagugaug

SEQ ID NO: 4895 - RNA, 81 nt, Rattus norvegicus
gugugauguaucacuucaggauguaccacccauuuaauggaaaauaugauugguacuucuuuaagugagauaaugcacacu

SEQ ID NO: 4896 - RNA, 98 nt, Rattus norvegicus
gugcucuuguggcccaugaaaucaagcuugggugagaccugguacagaacaggaaggcgacccauacuugguuucaguggcugcaagaauggcucuau

SEQ ID NO: 4897 - RNA, 96 nt, Rattus norvegicus
guauacacuauauuauguauaaauguauacacacuucuauaugugcccacauauauacaguguaucuauuauacugguauagguguuugugugcgc

SEQ ID NO: 4898 - RNA, 81 nt, Rattus norvegicus; identical to SEQ ID NO: 3811

SEQ ID NO: 4899 - RNA, 96 nt, Rattus norvegicus
ugauauuaugccauggcauugugucaauaugcgaugauguguugugauggcacagcgucaucacguggugacgcaacaucaugacguaagacauca

SEQ ID NO: 4900 - RNA, 79 nt, Rattus norvegicus; identical to SEQ ID NO: 3814

SEQ ID NO: 4901 - RNA, 92 nt, Rattus norvegicus; identical to SEQ ID NO: 3816

SEQ ID NO: 4902 - RNA, 84 nt, Rattus norvegicus
agcuguugugucgcuuccucaugcugacauauuuacgagagggugcaauucauaaccuucugguaagaguggcaguugaggggu

SEQ ID NO: 4903 - RNA, 78 nt, Rattus norvegicus
gguggcugacgggagguggagauagaacgagggugucggccauuuugugucuguuuccugccggacguggugguggcg

SEQ ID NO: 4904 - RNA, 81 nt, Rattus norvegicus
augcacugcacaacccuaggagggggugccauucacauagacuauaauugaauggcgccacuaggguugugcaguguacaa

SEQ ID NO: 4905 - RNA, 97 nt, Rattus norvegicus
auuuuucauucuuucaguguugaaacauucucuacugaaccaagcuccaaaacaaguucacugggguuuguuucacuauugcaagaauugcuaagua

SEQ ID NO: 4906 - RNA, 59 nt, Rattus norvegicus
cuggcuggggaaaaagauuggauagaaaacauuauucuauucauuuacuccccagccua

SEQ ID NO: 4907 - RNA, 59 nt, Rattus norvegicus
cuggcuggggaaaaugauuggauagaaaacauuauucuauucauuuacuccccagccua

SEQ ID NO: 4908 - RNA, 94 nt, Rattus norvegicus
agaacagggucuccuugaggggccucugccucuauccaggauuaucuuuuuaugaccaggaggcugaggucccuuacaggcggccucuuacucu

SEQ ID NO: 4909 - RNA, 99 nt, Rattus norvegicus
cugauucugccugcguggagcgggcacggcugugagagcccccuagguacagcggggcugcagcgugaucgccugcucacgcacaggaagugacgacag

SEQ ID NO: 4910 - RNA, 92 nt, Rattus norvegicus; identical to SEQ ID NO: 3823

SEQ ID NO: 4911 - RNA, 68 nt, Rattus norvegicus
gguaagugugccucgggugagcaugcacuuaacguagguguaugucacucggcucggcccacuaccca

SEQ ID NO: 4912 - RNA, 81 nt, Rattus norvegicus
caggaagaggaggaagcccuggaggggcuggaggugauggauguuuuccuccgguucucagggcuccaccucuuucgagcc

SEQ ID NO: 4913 - RNA, 80 nt, Rattus norvegicus
ccuuuaguuuugagguugguguacugugugugaguauacauauuuaucacacacagucgccaucuucgaaagugagggug

SEQ ID NO: 4914 - RNA, 83 nt, Rattus norvegicus
gccugaggggcucacagcuccgguccuuggagcuccagagaaaauguugcuccgggacugaguucugugcaccccccuugccc

SEQ ID NO: 4915 - RNA, 77 nt, Rattus norvegicus
ccugagccuugcacugagaugggagugguguaaggcucagguaugcacagcucccaucucagaacaaggcucgggug

SEQ ID NO: 4916 - RNA, 84 nt, Rattus norvegicus
ugcggcccagggacuggugcggaaagggcccacaguggacuuggugcacuguaugcccuaaccgcucagucccugggucuggca

SEQ ID NO: 4917 - RNA, 83 nt, Rattus norvegicus
guggacuguggcuugccgagccgugcuccgguaugagagauggccgagcacccgugucucggggcaaggacuggagguggcag

SEQ ID NO: 4918 - RNA, 137 nt, Rattus norvegicus
gucccuguggugacuugaggcugcucccuguggcuuugaacugugaggugacucuuggugugugauggcuuuucagcaaggucuuccucacaguagccauaaggacacgccagcaacgugacugaagggacaguggu

SEQ ID NO: 4919 - RNA, 107 nt, Rattus norvegicus
gugaguggggugguuggcauggguugcccagucuggggacucgacgcugugucacagccuccugauguccuccucacgcaugcccacccuuuaccccacuccagggc

SEQ ID NO: 4920 - RNA, 88 nt, Rattus norvegicus
gacugcccucaaggagcuuacaaucuagcuggggguagaugacuugcacuugaacacaacuagacugugagcuucuagagggcagggg

SEQ ID NO: 4921 - RNA, 68 nt, Rattus norvegicus
ccuaacuuugaaucucuucguagggugcuucagggaaagcuggggacccugggagagauguaagucaa

SEQ ID NO: 4922 - RNA, 96 nt, Rattus norvegicus
aaugucucaugugcauuggucuacauagauugguaccuaucauguaaaauaagugugaaagaugccacgcuauguagaucaacgcucaugacauuc

SEQ ID NO: 4923 - RNA, 77 nt, Rattus norvegicus
ggcagugcuuuacucacaugguugcuaaucacgugaaauguaagugaaagccaccauguuggguaaaguaaagcuca

SEQ ID NO: 4924 - RNA, 76 nt, Rattus norvegicus
ugcagugcuguauucagauuggugccugucauguuuauaagaaugaaagacgccaaacuggguagaguggagcuca

SEQ ID NO: 4925 - RNA, 77 nt, Rattus norvegicus
ugcagugcuguguucagacugguguccaucaugugaaauauuugugaaagacaccauacugaauagaguaaggcuca

SEQ ID NO: 4926 - RNA, 78 nt, Rattus norvegicus
ggugcgugaggugguugaccagagagcacacgcuauauuugugccguuugugaccugguccacuaacccucaguaucu

SEQ ID NO: 4927 - RNA, 97 nt, Rattus norvegicus
ggauuauaauaaauuaaaugccuaaacuggcagagugcaaacaauuuugacucagaucuaaauguuugcacuggcuguuuaaacauuuaauuuguuc

SEQ ID NO: 4928 - RNA, 80 nt, Rattus norvegicus
ggcgcgucgccccccucaggccaccagagcccggauaccucagaaauucggcucugggucuguggggagcgaaaugcaac

SEQ ID NO: 4929 - RNA, 76 nt, Rattus norvegicus
uggcaaguggaggagcagcagggugaaacugacacaguucuggugaguuucacuuugcugcuccuccugauuccca

SEQ ID NO: 4930 - RNA, 108 nt, Rattus norvegicus
ucaacacaaucaaaaucucggaggcaggugcucacauguccuccuccaugccuacacauacauggaggaggccauaguggcaacugucaccaugauugauuucguugg

SEQ ID NO: 4931 - RNA, 76 nt, Rattus norvegicus
cugugcccccagcaccacgugucugggccacgugagcaacgccacgugggccugacguggagcuggggccgcaggg

SEQ ID NO: 4932 - RNA, 96 nt, Rattus norvegicus
guccuauuauuugcagucaguaacaaagauucauccuugugucgaucauacagcacggagagucuuugucacucaguguaauuaauagccuucacc

SEQ ID NO: 4933 - RNA, 77 nt, Rattus norvegicus
ugcagugcccuauucagauuggugccggucacaugaaguacauaugacuggcaccauacuggauaauguaaugcuca

SEQ ID NO: 4934 - RNA, 81 nt, Rattus norvegicus; identical to SEQ ID NO: 3924

SEQ ID NO: 4935 - RNA, 77 nt, Rattus norvegicus
gugugcauuugcaggaacuugugagucuccuauugaaaauggacaggagacugacaaguucccgggaacacccacaa

SEQ ID NO: 4936 - RNA, 76 nt, Rattus norvegicus
uuagcccugcggccccacgcaccaggguaagagagacucgcuuccugcccuggcccgagggaccgacuggcugggc

SEQ ID NO: 4937 - RNA, 73 nt, Rattus norvegicus
ucugugguacuauaccucaguuuuaucagguguucauucaaaucaccugaaaacacugaggcugcgucccacu

SEQ ID NO: 4938 - RNA, 79 nt, Rattus norvegicus
aagugcuguggauuucucugugaaucaccauaucaaaucuaaugugguggugguuugcaaaguaauucauagugcuuca

SEQ ID NO: 4939 - RNA, 85 nt, Rattus norvegicus
guagaggagauggcgcaggggacacaagguaggccuugcgggucugugggcccuuggacauguguccucuucucccuccucccag

SEQ ID NO: 4940 - RNA, 77 nt, Rattus norvegicus
ugcagugcuuuaucuaguuggcugucagucacgugaaacucaagugcaugacaccauacuggguagaggagggcuca

SEQ ID NO: 4941 - RNA, 76 nt, Rattus norvegicus
uucuagauccagaggcuuauagcucuaagccuuggauaaaagaggcuuauggcuucaagcuuucggagcuggcgac

SEQ ID NO: 4942 - RNA, 78 nt, Rattus norvegicus
ugcacugcaauacucagauugguaugagucacuuccuaaaacauguuacuccauucauucugaguagagcaaggcaca

SEQ ID NO: 4943 - RNA, 77 nt, Rattus norvegicus
ugcaguacaauauucagagugguagcagucacuuuauucuaaaguaacuguggcauuucugaauagaguaauguuca

SEQ ID NO: 4944 - RNA, 77 nt, Rattus norvegicus
ugcacucaaugcugagagaaguagcaguuacuuuuuacucuuaaguaacugcaacaucucucaguauuguaaggcuc

SEQ ID NO: 4945 - RNA, 91 nt, Rattus norvegicus
ggcggcggcgcgggcggcaguggcgggagcggccccucggccauccuccgucugcccaguuaccgcuuccgcuaccgccgccgcucccgcu

SEQ ID NO: 4946 - RNA, 82 nt, Rattus norvegicus
gucucucagcuggugugagguugggccaggaugaaacccaaggcucuccgaggcuccccaccacacccugcugcugaagacu

SEQ ID NO: 4947 - RNA, 120 nt, Rattus norvegicus
ggugcuuacugcucucaggguagcugugaggaugguaaaccggugacgugcacuucauuuaugcuguaggucacccguuuuacuauccgccagcacccagaccgucugugggaugauacc

SEQ ID NO: 4948 - RNA, 120 nt, Rattus norvegicus
agccugcgccggagccgcggucugaguccgggucgcgcgggagaggaacucaucgaguugcgggugcggccggugcucagccggccagguuccgguaucccgcugccgcgcgcccuggag

SEQ ID NO: 4949 - RNA, 85 nt, Rattus norvegicus
gugaggacuggggagguggaggguaguaccauuagagccagagcucugucucagcucccucuccccccaccucuucucuccucag

SEQ ID NO: 4950 - RNA, 120 nt, Rattus norvegicus
ucuugcugcuccgauucuuguuugcauggggaggagggaggggaugggccaaguucccuaugccuggaacgcccuucccccccuucuucaccuggcgaacuccuacucguccuucaagac

SEQ ID NO: 4951 - RNA, 139 nt, Rattus norvegicus
ggcaaacugaagaaguguuggagagaugagggguuaagaguucauucggcuguccagauguauccaaguacccuguuauuuggcaauaaauacaucugggcaacugauugaacuuuucgcuucucuugacucaacugga

SEQ ID NO: 4952 - RNA, 73 nt, Rattus norvegicus
agucuccaccaccuccccugcaaacguccagugaugcagagguaauggacguuggcucugguggugauggaca

SEQ ID NO: 4953 - RNA, 64 nt, Rattus norvegicus
gaaaagguagauagaacaggucuuguuugcaaaauaaauucaagaccuacuuaucuaccaacag

SEQ ID NO: 4954 - RNA, 90 nt, Rattus norvegicus
agcgguccuacaugaauauggaggucucugucugacuuagaauaguuggcuaagucugaucguucaccuccauacaacuuuuagacuguc

SEQ ID NO: 4955 - RNA, 88 nt, Rattus norvegicus
acuagucucuaggaugugcucauugcaugggcuauguagauuucuauuuaauacacagaacaugcagugagaacuugauagagauugg

SEQ ID NO: 4956 - RNA, 97 nt, Rattus norvegicus
gggagaaaagcagccaauagcugguuggcauucugggccugguucaugccaacucuguuguuaacuauaccaggaugucagcauaguugcuuaccca

SEQ ID NO: 4957 - RNA, 110 nt, Rattus norvegicus
aucgccacaccuaaaggauccucauuaagguggguggaauaguauaacaaugugcucaauguuguuauaguaucccaccuacccugaugugucuuuaagacucuaacggu

SEQ ID NO: 4958 - RNA, 103 nt, Rattus norvegicus
gaggcuggcagcugcccucuucaacaaaaucacugaugcuggagucacugugcacccacucagcaccaggauauuguuggggaggacggccugggcagcgucg

SEQ ID NO: 4959 - RNA, 76 nt, Rattus norvegicus
aagaguaauuggaguucaugcaaguucuaaccaguuuaaccaguagcugggugaauugcaguacuccaacauucug

SEQ ID NO: 4960 - RNA, 111 nt, Rattus norvegicus
ccaagaagguggcagggcugugagugugagggaccccgagggagggcaggcugccccaggcccugcccccuccaggaagccuucuugcuccagccccacacacgaucucaa

SEQ ID NO: 4961 - RNA, 117 nt, Rattus norvegicus
gcuuuuugcucaagggcucgacuccuguuccugcugaacugagccagugugugaaaugagaacugauaucagcucaguaggcaccggagggcggguccaaucacagcugggcagugc

SEQ ID NO: 4962 - RNA, 113 nt, Rattus norvegicus
cugcuauuuacucugcgguuuguacugucugggagcagccaaggacaaguuaccucuugucuucuguccuuggccuuccuagguguccaagcucacgcaggcugggagccaga

SEQ ID NO: 4963 - RNA, 89 nt, Rattus norvegicus
gucccuacucugggaaggugccauucugaaggccaggagucugaauaugagucacucuggcugcuauggcccccucccagggcuugggc

SEQ ID NO: 4964 - RNA, 129 nt, Rattus norvegicus
aaaccucaagccugcugagcgaucgauccccaucccagcuuccuuccagcccuugauguuucaguaugcacauaggcuagaaagagguuggggauggggaaagaugagagcaucggaugcaggauugag

SEQ ID NO: 4965 - RNA, 137 nt, Rattus norvegicus
cgcagcuccaugagccugugaguggccaggguggggcuggguggugcaggcaggagagccauugaucuauugcgggcucuacucccugccccagccagagcaccccauuggcuacccacagguacacagcugccagu

SEQ ID NO: 4966 - RNA, 117 nt, Rattus norvegicus
gguugucauucaggcuggguugucaugugacugccugucugugccugcuguacaggugagcggauguucugcacagcaaguguagacaggcagacacaugacaacucuguccaucca

SEQ ID NO: 4967 - RNA, 67 nt, Rattus norvegicus
aucacaguccuauuucugcccucaaagacaaaaaugaugucuagggcuggagagauggcuaaguggg

SEQ ID NO: 4968 - RNA, 104 nt, Rattus norvegicus
gcucaggacugcccagugugcaguggugugaggagggggcguauccuaggcaucacacuaccucucccucccccucacugcacagaguugggcuggucacagcc

SEQ ID NO: 4969 - RNA, 117 nt, Rattus norvegicus
ccugaagaaaucgagaacuaugguagggagaguggggcauuggagcugcacagaggagggucaggccucugggugguagaaccaaggcucuucuuuccuugcagugcaccgaaucgg

SEQ ID NO: 4970 - RNA, 115 nt, Rattus norvegicus
ugauucaaaccaggagucgagugaugguucaaaccacgaguuugacaaugguucaaaccaugagucgagcugugguucaaaccaagagucaaucgacguuucaaaccuggaguca

SEQ ID NO: 4971 - RNA, 88 nt, Rattus norvegicus
cgguugaagggggugaagaaaggcaucauauaggagcugaauggcugugcaaucaacuccugcaugacgccguucccaccccccaacu

SEQ ID NO: 4972 - RNA, 116 nt, Rattus norvegicus
ggcugagagacgauagcuccucugaccaacaagcuuuuugcucgucuuauacgugagagucagguauaacccgggccaaaagcucacccgucaaaggaaguaagcaagggucagcc

SEQ ID NO: 4973 - RNA, 110 nt, Rattus norvegicus
cugacuuccaaggugggaagagggguggggcccgggacuguacccaugugaggacuauucuugagucccgcucuuguucugagcaccaccccucucucagaugguggcag

SEQ ID NO: 4974 - RNA, 120 nt, Rattus norvegicus
cuucggcgaguguugggucaccuuugaacaucguuaccagacaguguuagagucaagccaagaaauccagcacuguccgguaagaugcccacagaggcccagguaugcuuugguaggaag

SEQ ID NO: 4975 - RNA, 112 nt, Rattus norvegicus
gaaaaugccgguccugggagccgaggacugggacuuuguaggccaguugaacugacacccucaucuugcccgcaaagacccagcucucagcucccguccgccuuggaguucg

SEQ ID NO: 4976 - RNA, 114 nt, Rattus norvegicus
cuucuggagugccuggugaggggugguuugagcaguguggggcaugggguggcccucacugggcacaccaaccaagccgagcccaucccugcccuaggaauucaacccagaaga

SEQ ID NO: 4977 - RNA, 82 nt, Rattus norvegicus
uaugggcaguacugucuucaccaugguguuuuugacauaaguagcuaugaaauucaccaugguggguaaaguaaggcucaua

SEQ ID NO: 4978 - RNA, 105 nt, Rattus norvegicus
ugugaauccagcugguucaaggcugcaggcccacuucccuuggcagauuuuuccauuucagggaguggggaaaguggcccuaaaccaucaaaauggauuauacau

SEQ ID NO: 4979 - RNA, 106 nt, Rattus norvegicus
cggaucugucucugcucuguuuauggcccuucgguaauucacugaccgagacuguucacagugaauucuaccagugccauacacaggacaggagucacacucucug

SEQ ID NO: 4980 - RNA, 118 nt, Rattus norvegicus
gcauggugcuuuuccccaaucauuauaaccgauuucagauggugcuagaaaauucuauugacucugaacaccaaaagaaaucagucauccucuaaggggucacaagaggucaugugca

SEQ ID NO: 4981 - RNA, 107 nt, Rattus norvegicus
gcuggugcuuuucccccuacaucauaaccgauuucaaauggugcuagacaaaaacagacucugaacaccaggagaaaucggucagccuguguaagagauggaccagu

SEQ ID NO: 4982 - RNA, 113 nt, Rattus norvegicus
agcggggaaggugacuccacucaggccuucugacuccaaguccagugcuauuucgagguaacacacaggaccuggagucaggagcccuggguggcucugucacccccuggcug

SEQ ID NO: 4983 - RNA, 114 nt, Rattus norvegicus
gcagcuggaccuucacccgggcuguccauagaagucaucccacagugccuucaaggagggcaucggcacuguggaggguuucuaugucagccugagugguacagauccaugcug

SEQ ID NO: 4984 - RNA, 115 nt, Rattus norvegicus
cucagaagaaagccuuuuucucucugcgugacagacuuaguacuacaugauccauguuaaugaaacuaauguaguacugagucugucgugcagugaguaaaaaaauccaaagaga

SEQ ID NO: 4985 - RNA, 112 nt, Rattus norvegicus
ccucacaugcagaccaggcuuaccuuccccaaauccuugcccgggugcauugcauacaaauagcauuuucacccagggacaaaggauuagagaggacgagcagagcagaagg

SEQ ID NO: 4986 - RNA, 109 nt, Rattus norvegicus
agggcagacacucagaaccugagacugugucaauccaggguagacacucagaaccugagacugugucuauccaggguagacacucagaaccugaggcagcauauguccu

SEQ ID NO: 4987 - RNA, 112 nt, Rattus norvegicus
ucugguauaucaggcuugcugugauuuggggcaguggcuggaugggaggggacucacagcccuaucucuagugcaaccccuguccccacaggucuagagccugagauccaga

SEQ ID NO: 4988 - RNA, 112 nt, Rattus norvegicus
guuccaaacagcuucacuauuaucugucuucuguaucccucaagcuuuccccagugaacacagcacccugggaaaugcaaagagggaagacagagaggagcaugggguggga

SEQ ID NO: 4989 - RNA, 109 nt, Rattus norvegicus
agccgcugcgcggggccugcugggaaauguaguucaaaguucggcacgagcugcaggucucugccuaacaaugaacuaccacucccaguagucaacgcugcucagggcu

SEQ ID NO: 4990 - RNA, 101 nt, Rattus norvegicus
ugcaccaaacaccagugggcuuguucuucccgugcagaagcagcagagauaucaggcugguugggcccuggaagaacuagccacuuggugugacugggcag

SEQ ID NO: 4991 - RNA, 76 nt, Rattus norvegicus
cagucccuuccucggaggacagcagacucaggucgaaaucgggaccugagucugcgcuccucuccagcccuagacu

SEQ ID NO: 4992 - RNA, 117 nt, Rattus norvegicus
aguagauaaugguuagcuauaggguacaaucaacggucgaugguuuuuauuugaauuccaaacucaccgacagcguugaauguucacugaagcaaccugugagccagaggugugcug

SEQ ID NO: 4993 - RNA, 111 nt, Rattus norvegicus
uuggcggacauuaccuacccaaaauacacacuucuuuacauuccauagcauucuauguucauauggguacauaaagaaguaugugcucugaguaggcacuauugugccgau

SEQ ID NO: 4994 - RNA, 108 nt, Rattus norvegicus
ugccaccaguaaguggaggccaguuugggggacagggcaaggugggcaguagcugacagccuguuuacacuugcccuuuuuuccccaggcuauaguucgguuguggca

SEQ ID NO: 4995 - RNA, 72 nt, Rattus norvegicus
augguuugaggggcagugauagaaaggagauccuuuucuuucuucuccuuccuaacucugcccccucccauc

SEQ ID NO: 4996 - RNA, 118 nt, Rattus norvegicus
gccagggguucgcgcugcccagggacagaucagccgcugucacacgcacaguggguccggagcaacgcagugugcugugggcaguggcuguccugagccuggagggacugccccggug

SEQ ID NO: 4997 - RNA, 115 nt, Rattus norvegicus
uggacgccgaugacacaggggcaggggccuccaucauuacccggcaguauuagagacucccaaccagcacccaaacacugcuggguaagacgagggccccuacccaaccagucca

SEQ ID NO: 4998 - RNA, 115 nt, Rattus norvegicus
uccgccagggcaguauuugauacucgaaaagaaauuacccuuguaugauucauccaaaagagcaaacacaccaaggauaauuucuccucaaguaugaaacaguagcacagcagga

SEQ ID NO: 4999 - RNA, 113 nt, Rattus norvegicus
acgugguccuuaguggagguuugcuuguuauaggggcuaagaggggccaggcgugccugucaucaucugucccucuuggcccuuaggcucggcaugcuaccuauggcauccgu

SEQ ID NO: 5000 - RNA, 117 nt, Rattus norvegicus
ucuccaagcugagcauugauacugagaaaagaucaaccauguauuauucgaagucagcuaagcgaauauaacacggucgaucucccuucaaguaccagcagaggugccgagcugagg

SEQ ID NO: 5001 - RNA, 113 nt, Rattus norvegicus
acccuccacgaaugacuuugauaaugagaagauguggaccauacuacauacgacacagaaguagcgcauguucuauggucaaccaucuuuucagguaccauggagagagggug

SEQ ID NO: 5002 - RNA, 81 nt, Rattus norvegicus
gugugcuaugcccugcuuguacuuauucuggugacaugagguaucugugacuaggguaguaugaguagaguaaaguucacc

SEQ ID NO: 5003 - RNA, 90 nt, Rattus norvegicus
cacuaauggugagcaugaagaguucagaucacguucaugaagugcugaugaaccugacuucucucuucaugcaguugucuaucuuggugc

SEQ ID NO: 5004 - RNA, 81 nt, Rattus norvegicus
guagagcugggcgggaggaguccaggaggcgggagcugccgcggucugguagcccgcaucucuggauccccgcagccugca

SEQ ID NO: 5005 - RNA, 118 nt, Rattus norvegicus
gccacauggagcaaaucugugugcagugcuuuucacaagaaggugucuuucauggggauuaaaacaugaacggcccuuguugugaggaguaauguacaacauguaaugccuguguggu

SEQ ID NO: 5006 - RNA, 120 nt, Rattus norvegicus
cgggaggugaguaugacgaucccuguccucaaggagccucagucuaguagggaggagacauacuagacugugagcuccucgagggcaggaaagcgcuccaucaucugugcuccaugccca

SEQ ID NO: 5007 - RNA, 63 nt, Rattus norvegicus
uuguguggucggcagcgaaguuguucuccaccaagaacacugauuucaaauggugcuagacaa

SEQ ID NO: 5008 - RNA, 106 nt, Rattus norvegicus
cugcugguaccucuccgccuaggucccaagagccugacuugugauguuacuaaaauaccucacaaguuagggucucagggacuaggaaaagucugguuugaugcag

SEQ ID NO: 5009 - RNA, 112 nt, Rattus norvegicus
uccacgaacuuggugauacuccagagaggaaaccagcaaguguugacgcuaaccuggcagaaacaucaauacuuccuggcucccccacugggugcaucaauuuacuacugga

SEQ ID NO: 5010 - RNA, 74 nt, Rattus norvegicus
ggccgaugcccuuuuaacauugcacugcucgguacacguguagacaguagcacaaugugaaaagagcuccggcc

SEQ ID NO: 5011 - RNA, 109 nt, Rattus norvegicus
guagacggauagccuagcaguagcuguuuagugugaugauggcguuugauguuuuggacacaaacaccauugucacacuccagagcucugcuaaggagagucuguaggc

SEQ ID NO: 5012 - RNA, 116 nt, Rattus norvegicus
guccuuagagguagcauuugguacugaaaaaaguguuguccgugaaugauucgucacaaguaaagcgaauccaccacgaacaacuucucuucaaguaccacagaaaagcagagaca

SEQ ID NO: 5013 - RNA, 91 nt, Rattus norvegicus
ccaucaccacacgacuggauuuuggccuccgcaggguugaagcugcuagagaagcuucaaccuuaagggggccucagggagagaggagugg

SEQ ID NO: 5014 - RNA, 65 nt, Rattus norvegicus
ggcagagcccagggcagagcagugugaacagcgcuugucuucacaccgccucugcccgcuagugu

SEQ ID NO: 5015 - RNA, 120 nt, Rattus norvegicus
gugguuucccaagcagcauuugauacugaaaacguggauuuuccucuacgauuagucauuaauauuguacucauagaaggagaaucuaccuuuuaaauaucaaagaacaacucgauccag

SEQ ID NO: 5016 - RNA, 114 nt, Rattus norvegicus
guugcuuugugcaagucccaaggaaagcuaggaggcuguacaguuaucucccuuguuguaacucuaaacuauacaaccuacuaccucagccugggagcaugccgucacaguggc

SEQ ID NO: 5017 - RNA, 95 nt, Rattus norvegicus
ggcccuaagaaaggcagcaggucguauaguuaacuccuugugggcaaaaucucugcccuaaaacuaugcaaccuacuaccucuuccuaggagccc

SEQ ID NO: 5018 - RNA, 117 nt, Rattus norvegicus
ccccuuccagugcagggcgcagccuggggaaagcuaggaggccguauagugaucuccucgggugucuuccucaacuauacaaccuccuaccucagcccggggggcgcggcagguggg

SEQ ID NO: 5019 - RNA, 97 nt, Rattus norvegicus
acuccucagggaaggcaauagauuguauaguuaucuccuaaacaggguaaaaucacuaccccacaacuauacaaucuacuaccucacucugauagag

SEQ ID NO: 5020 - RNA, 67 nt, Rattus norvegicus
accccugccccugugcucuagcacacugcucagaaaacguuuaggguugcagagccagggugggggg

SEQ ID NO: 5021 - RNA, 78 nt, Rattus norvegicus
gagguguuugcuggauacacagaggcaggaggagaaagaaguauuuccuccugcaucuguguguauagcaggcacuuu

SEQ ID NO: 5022 - RNA, 139 nt, Rattus norvegicus
gucuuugccugcuucggaggugaugcugggcuacguccagaggcacugacagaucugauggugauuugguauaaggucgcagccuucaggccugucacagugcccggggaauuggccacuguggucucaaugguugugu

SEQ ID NO: 5023 - RNA, 101 nt, Rattus norvegicus
caccaagcuagcagguaggcucuggacaggacaggcccugagccagccaccgagcucugcagcucacgugcccuuccuguccucuagggguccaugcacua

SEQ ID NO: 5024 - RNA, 101 nt, Rattus norvegicus
acauccacaugucugucucuguggcacacaggugcaugcaugugugcucugacuuucacaugucugucucuguggcacacagaugcaugcacgugcacaca

SEQ ID NO: 5025 - RNA, 127 nt, Rattus norvegicus
aaagaccucuagucuccugcuugccuucugcugcagugaaccugagagaaaggcucgagcaauuagguuggggccuuacucacagucucacuggagacaucggguuauucuagguggauucagaagg

SEQ ID NO: 5026 - RNA, 109 nt, Rattus norvegicus
gagagaccggcggcggucagcacucaggccugugcccaaggacuccccgucugguucaaaggcugccuggcgcagggccuguagcugcucccgcugcuccuaaaguuaa

SEQ ID NO: 5027 - RNA, 127 nt, Rattus norvegicus
ucagaaauacucagcaguguuagaggagcuggauucacagggcaguggagaugccgagaggaaugagccuuucauucucgcugcucuggaguccugcucuucaguuucuucaucggcagagugaaca

SEQ ID NO: 5028 - RNA, 121 nt, Rattus norvegicus
augcccguggcaucaggcccaagugcugagauuacaaggcaguuaaagccaggaugagaaagucgugcugaacaugcuuguaaucucagcacuugggaggcuaaggcaggaggaucaagag

SEQ ID NO: 5029 - RNA, 141 nt, Rattus norvegicus
ucgaguguugaagucucagguagcagugcucaugggucucuacugcagugaguucuaugaagccucagguagcagugcucaugggucucuauugcagugaguucuaugaagccaaugcucucaugauggaagaagaaggcg

SEQ ID NO: 5030 - RNA, 119 nt, Rattus norvegicus
cagggcucugugugccuacgguccacuugugcuguggggaaaagugcaggucuguacgcaucuuuccugucuguaccacauggcacgguggaacacaggucucugucuuccuccuccug

SEQ ID NO: 5031 - RNA, 105 nt, Rattus norvegicus
ucugugaaugcagugagugcccagagcaggauggaggccggggaagguggccucacguccuggaacuccaucucuggucugugcaggcaaugugaggagucagac

SEQ ID NO: 5032 - RNA, 121 nt, Rattus norvegicus
uggaaucaccagauagcuggggucaaggugcucugcugacugccuaugggcugugggauccaacugagucaguaggccagacagcaagcaccuuuaucccuugagcaauuucacugacccu

SEQ ID NO: 5033 - RNA, 141 nt, Rattus norvegicus
guaauuguguuuccucuugaacuugcugcugaccuccgcugcugccaagagucuccgucuggccuuucaacugaacugaaagucagacagagacucugcagggaguuccaggccuucauugcuagauggggacugcugaga

SEQ ID NO: 5034 - RNA, 111 nt, Rattus norvegicus
cugcccuuugagugcugaaggugcuggaguccuuagcagguugccaagaguugcuagugccuccuggucuguaaagggacacagcacaagugcauuuaggagccucuugcu

SEQ ID NO: 5035 - RNA, 133 nt, Rattus norvegicus
agaagacacagaggagccucggucacagcaugguagacugcgaugucuguagucccggcugggcaggaagucuccggacuguagauccaucucccacagcuaggcugaggagucuguucugacuugugcucac

SEQ ID NO: 5036 - RNA, 97 nt, Rattus norvegicus
gagugcucuggugggaggggggagggcccagagcagcgguucugcugggcucucagaggccugcucugagcccccgccuccuccuucucagccuccc

SEQ ID NO: 5037 - RNA, 91 nt, Rattus norvegicus
aaggugacaguuugcaaugugacucagcuaucugaacagucaccccaaugucagacagcugagucacucugcaaauugucacccaaugcuu

SEQ ID NO: 5038 - RNA, 139 nt, Rattus norvegicus
gauggagugcagugugacauuucaugugcauguguguaauaaccagaucugggucauuucaguacauguacacaguguauaaugaccagaucugggucaacacauguguaacaaucagauccaggucaucggcagaccc

SEQ ID NO: 5039 - RNA, 123 nt, Rattus norvegicus
cucacaccgacaacuuugagguggcaacagcuuugguggcuuaguucuuugugcuugguuugggagacacugagacuaacucaccugucuguuguugcuguuaaaucuuaauccagaggaacu

SEQ ID NO: 5040 - RNA, 121 nt, Rattus norvegicus
uaacccaggucuugguugccacggcuucucauuagcuccuuaagaucccuguggagcacugguugcuccgcagggacugcaaggagccgcaggacagauggcagcugcuuggacugcucuc

SEQ ID NO: 5041 - RNA, 111 nt, Rattus norvegicus
ggaaggaguccaggcugcuuugguccccagguuauggcugcucaccuccaccugccagacagguaggcuggacuugaacagcccgccuggugucccccgcaggcugcguua

SEQ ID NO: 5042 - RNA, 99 nt, Rattus norvegicus
cuucugucacccuggaagcagacucgggaaacagccuaagcacuguaaucacuagugccaggcucucccagcugccggcuugggaucugaugggaagcc

SEQ ID NO: 5043 - RNA, 82 nt, Rattus norvegicus
gucuuuagugaaggagaaaggggcuagguggugagacacauacccgagacucaacgcuacguggcucgucuucugccucaga

SEQ ID NO: 5044 - RNA, 81 nt, Drosophila melanogaster
auuugacuacgaaaccgguuuucgauuugguuugacuguuuuucauacaagugagaucauuuugaaagcugauuuugucaa

SEQ ID NO: 5045 - RNA, 78 nt, Drosophila melanogaster
ucuggcaaauugagguaguagguuguauaguaguaauuacacaucauacuauacaaugugcuagcuuucuuugcuuga

SEQ ID NO: 5046 - RNA, 91 nt, Drosophila melanogaster
uucagccuuugagaguuccaugcuuccuugcauucaauaguuauauucaagcauauggaauguaaagaaguauggagcgaaaucuggcgag

SEQ ID NO: 5047 - RNA, 76 nt, Drosophila melanogaster
gcugggcucucaaagugguugugaaaugcauuuccgcuuugcgcggcauaucacagccagcuuugaugagcuuagc

SEQ ID NO: 5048 - RNA, 72 nt, Drosophila melanogaster
aucuaagccucaucaagugguugugauauggauacccaacgcauaucacagccagcuuugaugagcuaggau

SEQ ID NO: 5049 - RNA, 77 nt, Drosophila melanogaster
cuucaacugucuucaaaguggcagugacauguugucaacaauauucauaucacagccagcuuugaggagcguugcgg

SEQ ID NO: 5050 - RNA, 83 nt, Drosophila melanogaster
uugugucauucuucaaagugguugugaaauguuugccuuuuuaugccuauucauaucacagccagcuuugaggagcgacgcga

SEQ ID NO: 5051 - RNA, 102 nt, Drosophila melanogaster
ucguaucuuacuuucaaugucaucaaaaagggcugaagaaagauauuucugcauuugaaucguaucacagccagcuuugaugggcauugcaaugagcagcga

SEQ ID NO: 5052 - RNA, 69 nt, Drosophila melanogaster
gauccugggaugcaucuugugcaguuauguuucaaucucacaucacugggcaaagugugucucaagauc

SEQ ID NO: 5053 - RNA, 81 nt, Drosophila melanogaster
uugcaauuaguuucuuuggucguccagccuuaggugauuuuuccggucauaaagcuagacaaccauugaaguucguugugg

SEQ ID NO: 5054 - RNA, 69 nt, Drosophila melanogaster
gcuaaaaggaacgaucguugugauaugaguuguuuccuaacauaucacagugauuuuccuuuauaacgc

SEQ ID NO: 5055 - RNA, 82 nt, Drosophila melanogaster
uuuaauguagagggaauaguugcugugcuguaaguuaauauaccauaucuauaucacaguggcuguucuuuuuguaccuaaa

SEQ ID NO: 5056 - RNA, 74 nt, Drosophila melanogaster
uaacccaagggaacuucugcugcugauauauuauugaaaaacuacuauaucacaguggcuguucuuuuugguug

SEQ ID NO: 5057 - RNA, 80 nt, Drosophila melanogaster
caaaaagaagggaacgguugcugaugauguaguuugaaacucucacaauuuauaucacaguggcuguucuuuuuuguuug

SEQ ID NO: 5058 - RNA, 88 nt, Drosophila melanogaster
gagugcauuccguauggaagacuagugauuuuguuguuuggucuuugguaauaacaauaaaucccuugucuucuuacggcgugcauuu

SEQ ID NO: 5059 - RNA, 87 nt, Drosophila melanogaster
aaggacaucuguucacaucuuaccgggcagcauuagauccuuuuuauaacucuaauacugucagguaaagaugucguccguguccuu

SEQ ID NO: 5060 - RNA, 78 nt, Drosophila melanogaster
gcuauguugucuuugguuaucuagcuguaugagugauaaauaacgucauaaagcuagcuuaccgaaguuaauauuagc

SEQ ID NO: 5061 - RNA, 91 nt, Drosophila melanogaster
ugcauauuauuugcucuuuggugauuuuagcuguaugguguuuauguauauuccauagagcuuuauuaccaaaaaccaaaugguuucugca

SEQ ID NO: 5062 - RNA, 92 nt, Drosophila melanogaster
auuuuugcuguuucuuugguauucuagcuguagauuguuucacgcacauuguauaucaucuaaagcuuuuauaccaaagcuccagcuuaaau

SEQ ID NO: 5063 - RNA, 77 nt, Drosophila melanogaster
ccacgucuacccuguagauccgaauuuguuuuauacuagcuuuaaggacaaauucgguucuagagagguuugugugg

SEQ ID NO: 5064 - RNA, 75 nt, Drosophila melanogaster
gcacuugucaagaacuuucucugugacccgcguguacuuaaaagccgcaucacagucugaguucuugcugagugc

SEQ ID NO: 5065 - RNA, 74 nt, Drosophila melanogaster
uacgguugaguauuacaucagguacuggugugccuuaaauccaacaaccaguacuuaugucauacuacgccgug

SEQ ID NO: 5066 - RNA, 75 nt, Drosophila melanogaster
uacguaacuccucaaaggguugugaaaugucgacuauuaucuacucauaucacagccauuuugaugaguuucgug

SEQ ID NO: 5067 - RNA, 68 nt, Drosophila melanogaster
ccaugucguuaaaauguuugugaacuuauguauucacaaucauaucacagccauuuugacgaguuugg

SEQ ID NO: 5068 - RNA, 70 nt, Drosophila melanogaster
uauuaacgcgucaaaaugacugugagcuauguggauuugacuucauaucacagccauuuugacgaguuug

SEQ ID NO: 5069 - RNA, 63 nt, Drosophila melanogaster
ugugggagcgagacggggacucacugugcuuauuaaauagucagucuuuuucucucuccuaua

SEQ ID NO: 5070 - RNA, 92 nt, Drosophila melanogaster
uccguugguaaauuggcaagaugucggcauagcugacguugaaaagcgauuuugaagagcgcuaugcugcaucuagucaguuguucaaugga

SEQ ID NO: 5071 - RNA, 127 nt, Drosophila melanogaster
caaauaaugaauuuggcaagaugucggaauagcugagagcacagcggaucgaacauuuuaucguccgaaaaaaugugauuauuuuugaaaagcggcuaugccucaucuagucaauugcauuacuuug

SEQ ID NO: 5072 - RNA, 99 nt, Drosophila melanogaster
cucuuccucuggagaugacacgaaggugcauuguagucgcauugucugucccaauugcuucaggcaauacaacuucagugcaagcucugugcauuucac

SEQ ID NO: 5073 - RNA, 99 nt, Drosophila melanogaster
aauuggcuaugcgcuuuggcagugugguuagcugguuguguagccaauuauugccguugacaauucacagccacuaucuucacugccgccgcgacaagc

SEQ ID NO: 5074 - RNA, 97 nt, Drosophila melanogaster
ugaagcugacuugccauugcuuuggcgcuuuagcuguaugauagauuuaaacuacuucauaaagcuagauuaccaaagcauuggcuucugcagguca

SEQ ID NO: 5075 - RNA, 99 nt, Drosophila melanogaster
aacacauuucauucgcgccuguaucuugcugaaccgcugccauuauggccaacgauccgguugagcaaaauuucaggugugugagaaauguguuuagca

SEQ ID NO: 5076 - RNA, 95 nt, Drosophila melanogaster
aauaugaauuucccguaggacgggaaggugucaacguuuugcauuucgaauaaacauugcacuugucccggccuaugggcgguuuguaauaaaca

SEQ ID NO: 5077 - RNA, 100 nt, Drosophila melanogaster
uaaaacgucaccugauguaggccgugcccagugcuuauuuguugcauuuucgaaauacaaauugcacuagucccggccugcaaugagugucgcagucgac

SEQ ID NO: 5078 - RNA, 100 nt, Drosophila melanogaster
ccauuaacagaaacccguaaauccgaacuugugcuguuuuauaucuguuacaagaccggcauuaugggagucugucaaugcaaacaacugguuuuuggca

SEQ ID NO: 5079 - RNA, 100 nt, Drosophila melanogaster
ucauuugguacguuuuucuccugguauccacuguaggccuauauguauuuccaccauaaggcacgcggugaaugccaagagcgaacgcaguucuacaaau

SEQ ID NO: 5080 - RNA, 110 nt, Drosophila melanogaster
gacaugugcaaauguuuguauggcugauucccugagacccuaacuugugacuuuuaauaccaguuucacaaguuuugaucuccgguauuggacgcaaacuugcugauguu

SEQ ID NO: 5081 - RNA, 98 nt, Drosophila melanogaster
accugcaacacuguguguagcugguugacaucgggucagaucuguuuuucaagcauuugguccccuucaaccagcuguagccagugguugaugacaac

SEQ ID NO: 5082 - RNA, 91 nt, Drosophila melanogaster
caaucuccaauggccacguguaugcucguagcuauaaccugaaauccaaauguuauugcuugagaauacacguaguucaccgagauuuguu

SEQ ID NO: 5083 - RNA, 100 nt, Drosophila melanogaster
gguuggccggugcauucguacccuuaucauucucucgccccgugugcacuuaaagacaacuggacggagaacugauaagggcucguaucaccaauucauc

SEQ ID NO: 5084 - RNA, 100 nt, Drosophila melanogaster
cgaacuaauugaugguuccagugagauauguuugauauucuugguuguuucauucaaaaguucacccaggaaucaaacauauuauuacugugacccucgc

SEQ ID NO: 5085 - RNA, 108 nt, Drosophila melanogaster
ugugugcccuuauuaugguugggauuuuuuagaucagcaguuauugcuauauagccauauuuauaaaucuucuacuggccuacuaagucccaacauaaugagaguaaa

SEQ ID NO: 5086 - RNA, 100 nt, Drosophila melanogaster
aaaggugcuuauugcagcugcuggccacugcacaagauuagacuuaagacucuugugcgugugacagcggcuauuguaagaggccauagaagcaacagcc

SEQ ID NO: 5087 - RNA, 100 nt, Drosophila melanogaster
uaauucgauuuuuagcuaugauuguccaaacgcaauucuuguugauauucaauauucaaggguugcgacugggcaucgcggcucgaaauaagaauacaac

SEQ ID NO: 5088 - RNA, 93 nt, Drosophila melanogaster
accaaguucgcuuuccuaaguacuagugccgcaggaguuagguucguguccgcaauaccuccugcugcccaagugcuuauuaaagcggcgagu

SEQ ID NO: 5089 - RNA, 94 nt, Drosophila melanogaster
uagaucucggcacaguuaauggcacuggaagaauucacgggguaauuuuuauacaacccgugaucucuuaguggcaucuauggugcgagaauaa

SEQ ID NO: 5090 - RNA, 90 nt, Drosophila melanogaster
uugcugacuuugagucuuggcacugggagaauucacaguugacuuuauuauucugugguucugcgggugccaaaacuuaaaaaccggcuu

SEQ ID NO: 5091 - RNA, 100 nt, Drosophila melanogaster
uccuguguugcaguuucguuuugugaccgacacuaacggguaauuguuuggccgccaggauuacucguuuuugcgaucacaaauuaugaaauugcagcaa

SEQ ID NO: 5092 - RNA, 98 nt, Drosophila melanogaster
uguaaagucuccuaccuugcgcgcuaaucagugaccggggcugguuuuuuauauacagucagguaccugaaguagcgcgcgugguggcagacauauau

SEQ ID NO: 5093 - RNA, 98 nt, Drosophila melanogaster
ccugguuuuugccaucagcgagguauagaguuccuacguucauuauaaacucguaggaacuucauaccgugcucuuggaagaccaaaaaacaaccaag

SEQ ID NO: 5094 - RNA, 99 nt, Drosophila melanogaster
aaaaccgaagucuuuuuaccaucagcgagguauagaguuccuacguuccuauauucagucguaggaacuuaauaccgugcucuuggaggacugucgacc

SEQ ID NO: 5095 - RNA, 100 nt, Drosophila melanogaster
uugaagguuuugggcugcgugucaggagugcauuugcacugaaacuaucugaagcauguaaaugcacuaucugguacgacauuccagaacguacaaucuu

SEQ ID NO: 5096 - RNA, 98 nt, Drosophila melanogaster
guaaugguacggugcgaccggaugaugguucacaacgaccgugucauuuaaacgggucggugggacuuucguccguuuguaacgccauuugucaacga

SEQ ID NO: 5097 - RNA, 100 nt, Drosophila melanogaster
ggaauucauacuacuguuuuuaguggguggggguccaguguuucacauugauuuucuuaguauuugugacuagauccacacucauuaauaacgguaguuc

SEQ ID NO: 5098 - RNA, 95 nt, Drosophila melanogaster
uggcuuuuauguauuuacguugcauaugaaaugauauuuauaguaaacagauuauuuuauaugcagguauaugcaagucgagguccuccacacug

SEQ ID NO: 5099 - RNA, 90 nt, Drosophila melanogaster
cgaauaagugaauaaagagagcuguccgucgacaguccagaaacuauuuaauaucacugucauggaauugcucucuuuguauaauauucg

SEQ ID NO: 5100 - RNA, 92 nt, Drosophila melanogaster
cgaauugugaaaugaagagagcuauccgucgacagucaaguuaagaccgauuguaauacugucauggaauugcucucuuuguauaacauucg

SEQ ID NO: 5101 - RNA, 97 nt, Drosophila melanogaster
aguuuccuucuaaaucuagccucuacuaggcuuugucugugcauucgaaagccgaucagacauagccuauaagagguuagguguaccaaggcgaaca

SEQ ID NO: 5102 - RNA, 100 nt, Drosophila melanogaster
cucacacgauucucaaagguaaauaucagcugguaauucugggagcuaagccuaaauaugaaacacucggaauuucaguugguaucgacuuuuuugaauu

SEQ ID NO: 5103 - RNA, 100 nt, Drosophila melanogaster
guugcaguuccuggaauuaaguugacuguguagccugugagggcaaggcuugaauaaugcuccugaagucagcaacuugauuccagcaauugcggcccga

SEQ ID NO: 5104 - RNA, 99 nt, Drosophila melanogaster
ucgaaucgaagaacugagaucgauuggugcauagauaucaggagaacccacucaauuuaacucuagcaccauucgaaaucagugcuuuugauaagaaac

SEQ ID NO: 5105 - RNA, 100 nt, Drosophila melanogaster
uuaaaauugaauggcgaaugucgguauggucucuuuuucaaagaaagguuucgauuaagcgaagugacuagaccgaacacucgugcuauaauuuuaaaau

SEQ ID NO: 5106 - RNA, 93 nt, Drosophila melanogaster
ggacgccggggauguauggguguguagggucugaaauuuugcacacauuuacaauaauuguaaauguguugaaaaucguuugcacgacuguga

SEQ ID NO: 5107 - RNA, 97 nt, Drosophila melanogaster
cggccaugucguaauuagcggagcacggcaucgccggcgauaauuaaugacgguggucacguugguuucaugucgauuucauuucaugacacggccg

SEQ ID NO: 5108 - RNA, 99 nt, Drosophila melanogaster
gaguuuacaguaaaauaaauauuuaaguggagccugcgacuucagucccucugacugacugggguaagucacuugagcguuuguuggcacguaaaagac

SEQ ID NO: 5109 - RNA, 70 nt, Drosophila melanogaster
ucuugguuuagguuucacaggaaacugguuuaauaacgaaaacuaguuuccucuaaaauccuaaucaaga

SEQ ID NO: 5110 - RNA, 88 nt, Drosophila melanogaster
gcagcauugaauaaucucaauuuguaaaugugagcgguuuaagccauuugacgcacucacuuugcaauuggagauugcucgagacugc

SEQ ID NO: 5111 - RNA, 73 nt, Drosophila melanogaster
caugucuauuguacuucaucaggugcucuggugugucucguaacccggcacauguugaaguacacucaauaug

SEQ ID NO: 5112 - RNA, 85 nt, Drosophila melanogaster
guccacucgauggcucagguacuuagugacucucaaugcuuuugacauuuugggggucacucugugccugugcugccagugggac

SEQ ID NO: 5113 - RNA, 88 nt, Drosophila melanogaster
ugucuugcuuugacucacucaaccugggugugauguuauuucgauaugguauccaucacaaccuccuugagugagcgauagcaggaca

SEQ ID NO: 5114 - RNA, 120 nt, Drosophila melanogaster
uaguuucguggauacucuguccugcuaucgcucacucaaggagguugugauggauaccauaucgaaauaacaucacacccagguugagugagucaaagcaagacaaaaugcugcuaacuu

SEQ ID NO: 5115 - RNA, 63 nt, Drosophila melanogaster
cucgcaguauauuuuuguguuuuguuucguuuugcaauccaaaucacaggauuauacugugag

SEQ ID NO: 5116 - RNA, 69 nt, Drosophila melanogaster
auuauacgacaaaccuuguucgguuuugccaauuuccaagccagcacuggguaaaguuuguccuauaau

SEQ ID NO: 5117 - RNA, 89 nt, Drosophila melanogaster
aacauaaacauuugcagggcgggucgugugucaguguauuuauaucuuagcuauauugcacacuucccggccuuuaaauguccaauguu

SEQ ID NO: 5118 - RNA, 84 nt, Drosophila melanogaster
ucuagaucauuuuucggacgguauauggguuaauauuucauuugucgaauauauugcacauucaccggccugaaaauaucaaga

SEQ ID NO: 5119 - RNA, 66 nt, Drosophila melanogaster
gauuugguucgucacaagggcaauucugcauuuuuuaacuaguauugcacuugagacggccugauu

SEQ ID NO: 5120 - RNA, 71 nt, Drosophila melanogaster
auuuucugcugcggaugggggcaguacuguuuuuuuaacauugaguauugcacuuuucacagcccgaaaau

SEQ ID NO: 5121 - RNA, 90 nt, Drosophila melanogaster
ucguaacuuguguggcuucgaacuuaccuaguugaggaaaacucccaugucggauuuuguuaccucugguauucgagccaauaaguucgg

SEQ ID NO: 5122 - RNA, 84 nt, Drosophila melanogaster
cacuuauauaauuuugauuguugcucagaaagcccucauuguuuaccaguuggcuuucgagcaauaauugaaaccagauaagug

SEQ ID NO: 5123 - RNA, 89 nt, Drosophila melanogaster
aaauucuagucgauuugucuuuuuccgcuuacuggcguuucaauuccacaacgacaggaaagggaaaaaggcguauuuacuaugaguuu

SEQ ID NO: 5124 - RNA, 92 nt, Drosophila melanogaster
augcaacugccauugggauacacccugugcucgcuuugaaugaaaugcaagcaagugaacacagcuggugguauccaguggccguuuggcau

SEQ ID NO: 5125 - RNA, 68 nt, Drosophila melanogaster
uuuaugggauacacacaguucaguuuugucacacuucaagcaucacugggcuuuguuuaucucaugag

SEQ ID NO: 5126 - RNA, 91 nt, Drosophila melanogaster
ccgggcagcgaauuacuugggccaagggaaugcaaacugugaucaucccgaaaguuuguucguuuggcuuaaguuauuuucauguccgacu

SEQ ID NO: 5127 - RNA, 92 nt, Drosophila melanogaster
ugguugcuguagaguuuuagaauuccuacgcuuuaccguggcauacgaaauucggcaaagcguuuggauucugaaacccuaccgauccauua

SEQ ID NO: 5128 - RNA, 88 nt, Drosophila melanogaster
aguccugguggagcucaaauugacucuaguagggaguccuuuaaugagcgacucccuaacggagucagauugagcugcaaaggagcga

SEQ ID NO: 5129 - RNA, 91 nt, Drosophila melanogaster
uugguuuugaaguuuucaauuccguagugcauugcaguguguuucauuauuuacugcaagcgcugcggauuuggcaacuuugacgaccuuc

SEQ ID NO: 5130 - RNA, 87 nt, Drosophila melanogaster
uacaaacacaagauuuucuggguguugcguuguguguaccuguguacaggcguauucacaugcaacaucccuuacaucuugcuugau

SEQ ID NO: 5131 - RNA, 97 nt, Drosophila melanogaster
ggccagcuaaucaacuccaucgugcagagguuugaguguccuguguuuugccuaaucgcauucaauuucugaacgguagagaugguacgcuuagaaa

SEQ ID NO: 5132 - RNA, 148 nt, Drosophila melanogaster
gaucguuaucguguuuggaauggucucguuagcuaacggaugagcaagugcucggcucacuggcccaaaugcaguuugcccggagacgccgguuaacccagcacugaaauguguaguuucgagaccacucuaauccauugcagcauuu

SEQ ID NO: 5133 - RNA, 96 nt, Drosophila melanogaster
uguccacaauagaccuuaguuuucgacguguuuuggugugcuggggaguucuauuccgauugaaaccguccaaaacugaggccaacugugaggcgc

SEQ ID NO: 5134 - RNA, 92 nt, Drosophila melanogaster
ggcgugucuauggcaaguagaauagcaggcuuaucacauguuuaauucaaucugcugugagauucuucuauucuacuuucgacaacacccgu

SEQ ID NO: 5135 - RNA, 98 nt, Drosophila melanogaster
uuaacuuuguucuauauucuuaguacucggguugauaaagaccuuuucuucagggagccuuugucaucggggguauuaugaaauauaguuuaaagaaa

SEQ ID NO: 5136 - RNA, 93 nt, Drosophila melanogaster
ggguuuuguaccacauucugaguauuccagauugcauagcuuugugcuacuauugcuauacggucugggacacuuuuaacaugguaucaaauc

SEQ ID NO: 5137 - RNA, 89 nt, Drosophila melanogaster
ucaagggccgaguuaccuuugaucaccaguaacugagauuguuucugauacgguuucguuuucuggcaaucaaaagaacuuggacucga

SEQ ID NO: 5138 - RNA, 92 nt, Drosophila melanogaster
gauggggcacucaggcuauaagguagagaaauugaugcugucuacacuauucagacuucaguuucauuaccuuucaauuuguuugcccccau

SEQ ID NO: 5139 - RNA, 89 nt, Drosophila melanogaster
uuagucuaaucuaaaacaagguaaauaucagguuguuuccuguauucgaucgaaacaucuguauauaccuuuguuccgauuggacaaaa

SEQ ID NO: 5140 - RNA, 100 nt, Drosophila melanogaster
caauaacauauugguccaacuugccuuagaauaggggagcuuaacuuauguuuuugauguuuaaguuaaaagccucuguucuaagacaauuugaugauca

SEQ ID NO: 5141 - RNA, 107 nt, Drosophila melanogaster
gacaauauugcucaacauuuugggggguaaaacuguacguuauaugugcccuucugugauauucauaagcguauagcuuuuccccuuaaaaguuagagcuauugcaa

SEQ ID NO: 5142 - RNA, 87 nt, Drosophila melanogaster
aaccugauccgcugcuguggguugugggcuguguggcugugguauaggugccgccaguugauaacccccagcgugggcacggaccca

SEQ ID NO: 5143 - RNA, 97 nt, Drosophila melanogaster
cuuggagagcagagauaccucuggagaagcgcgugaccugaccccagcaggagaacccaacccgcuuuuccaccuaggugucucucucucucuuuau

SEQ ID NO: 5144 - RNA, 92 nt, Drosophila melanogaster
ugauggaagcuuccuuaaguaguauccauuaaaggguuguucucaacaugcaaaucaaccuuuugauguacuacuuuaagaaucuccaguua

SEQ ID NO: 5145 - RNA, 94 nt, Drosophila melanogaster
agucucuguccuacguccgaguuccacuaagcaaguuuugagaucguuuuaaaaacaaaaacuugacacguugagcucguucgugggauggacu

SEQ ID NO: 5146 - RNA, 95 nt, Drosophila melanogaster
gaaaggcaucuguugcagcuagcggguguuuuauuugguagcuguaaugauuugaaucuaucauaagacacacgcggcuauaaccguugucuaag

SEQ ID NO: 5147 - RNA, 96 nt, Drosophila melanogaster
uccguggcuggcaucgcucgcuguaaauuguaaucaucaaagcguuuucucagagccgcuugguguuacuucuuacagugagugugccaguccgua

SEQ ID NO: 5148 - RNA, 91 nt, Drosophila melanogaster
agaaugauagggaaauugcuaaauauuuuuuuuguauaaauaacuuuuaacuuuuguacaauacgaauauuuaggcauuucucaaaucaaa

SEQ ID NO: 5149 - RNA, 101 nt, Drosophila melanogaster
accgucgucgacuuuucgugguuggugguugaacuucgauuuuaaguauuuaaauaaaaugaaaucuguucauucuccgacacaagaaguucacgcaaagg

SEQ ID NO: 5150 - RNA, 101 nt, Drosophila melanogaster
caauugucaccggucauguccuccaagcgagcaaagaaguaguauuuguguuuccaagagcaaauauaacuucauuggaagcuaaguggauuugcccaaau

SEQ ID NO: 5151 - RNA, 91 nt, Drosophila melanogaster
uugaauuuuugauuuuaaacacuuccuacauccuguauguguuuugcauccgguacagaugugggagucguuugcacucagagauuucaca

SEQ ID NO: 5152 - RNA, 97 nt, Drosophila melanogaster
caucgccaugcagugccgcggcauuggugaggccaucuccaauggauuaguucucaacauuggauuaguuaucaucaaugccggugcacugcaccua

SEQ ID NO: 5153 - RNA, 99 nt, Drosophila melanogaster
cgaaucaacaaacaagguaugcuuuagauaacucgaauaucacaucuucaguguucgaaaucugaugagauauucacguugucuaaaucauguuuugua

SEQ ID NO: 5154 - RNA, 92 nt, Drosophila melanogaster
guuggcggcacaaucugcaaucuacgccacuggcuuacguugcaaucgaaaaucguguccagugccguaaauugcaguugugugaacgcaaa

SEQ ID NO: 5155 - RNA, 95 nt, Drosophila melanogaster
uacaugugaggaugucacaaauacacugaauuuggggggaauucuuauguauauacaaauucuucccgaacucaggcuaauuuuguggcauccgu

SEQ ID NO: 5156 - RNA, 98 nt, Drosophila melanogaster
aguugauuguaugucaguuuuucauuuggccuggcuagcuuacuccuuuuuaaauauugcuagcugccuugugaagggcuuacguguaauugcaguuc

SEQ ID NO: 5157 - RNA, 97 nt, Drosophila melanogaster
aaacauccucacugaagucggguuucguuagcagcgggcuguuuuaauaaauucaacaaguucguugucgacgaaaccugcaugcuguguggaaaau

SEQ ID NO: 5158 - RNA, 93 nt, Drosophila melanogaster
cgaaaucauguuagauccuggacaaauaugaaguaaauuguuuuuaugcaucaauuacuugauauucauccuugaacuaaaugguuuuagagc

SEQ ID NO: 5159 - RNA, 91 nt, Drosophila melanogaster
uauauugcaauaauuaaauaauacguuucgaacuaaugauuuucaguucauucauuagguaguuacgcauuaucuaguuguuguaaacauu

SEQ ID NO: 5160 - RNA, 99 nt, Drosophila melanogaster
uauuauauugcaauaauuaaauaauacguuucgaacuaaugauuuucaguucauucauuagguaguuacgcauuaucuaguuguuguaaacauucaacu

SEQ ID NO: 5161 - RNA, 90 nt, Drosophila melanogaster
agaaacaaauuucauugagguaaauacgguuggaauuuugucuuuuaacuauaaauccaaccgaauuuggcucggcgaaauuuuucaguu

SEQ ID NO: 5162 - RNA, 86 nt, Drosophila melanogaster
uauauaauagcacugcuggcucauugguacauuucauaaguaccuuaucaaauguuccaauggucgggcagagcuauuauuugucc

SEQ ID NO: 5163 - RNA, 100 nt, Drosophila melanogaster
cacaccugaaauuacccaucucgaauagcguugugacugagguaacugcgcaucgaaucuacucagcggcgaggcuauucaaguaagguuauuuugggcc

SEQ ID NO: 5164 - RNA, 94 nt, Drosophila melanogaster
uguuggacuguguuuaaaguaaauagucuggauugaugaaaguugcauucgagaauucaucaacaggcauuuacuucaacugcaguuugaacaa

SEQ ID NO: 5165 - RNA, 99 nt, Drosophila melanogaster
gacggcgguaccgggcauuuugggugugugauuuguagcaaagugauauguauuugaucauccccuuguugcaaaccucacgccaaagaugaucugcga

SEQ ID NO: 5166 - RNA, 174 nt, Drosophila melanogaster
aaagauuuugggaaucggccacuaccuugcagucacgugaugaaaagacacaggugacacugauccggauuugguaguugacaaauccuccaugccgagauuaguuucauuuugcgucuuuugaauucgaauaguucaugugaugugacguaguggaacauaccugaaauuaca

SEQ ID NO: 5167 - RNA, 86 nt, Drosophila melanogaster
ucugcucugcgacauucaccguucugaguuggccccaagugcacgugggccagcuuucagcuucggugccauuucaccccgagcac

SEQ ID NO: 5168 - RNA, 96 nt, Drosophila melanogaster
uaucacugcaguuucaggcuuuucccaacuacaccuauuaauacauauuuuaacguccuauuaaaguuguaguuuggaaaguuuugguuuugcauu

SEQ ID NO: 5169 - RNA, 92 nt, Drosophila melanogaster
auuuucccaagugccugguaucagcaaaguguuauuuuuuauguuuauguaaaguacacguuucugguacuaaguacuucgagaaaguuacc

SEQ ID NO: 5170 - RNA, 119 nt, Drosophila melanogaster
aacgcucccgugaccuacccuguaguuccgggcuuuuguuuaaauggcguucggcacauugucggacugcuggcucgauuaucagaagcucgucucuacagguaucucacaggguagaa

SEQ ID NO: 5171 - RNA, 91 nt, Drosophila melanogaster
uaucgaguuaucuaaggaaauaguagccgugauuuuacccaagaauuuuucacauaucacaguugcuguuucuuuuagauagcucuuuugu

SEQ ID NO: 5172 - RNA, 90 nt, Drosophila melanogaster
caccugcaccccgcagcccgaauuaugugggagcugcgccguuuccguaauccguagcaccacaugauucggcuucgugguacaggauau

SEQ ID NO: 5173 - RNA, 97 nt, Drosophila melanogaster
ucugacucuauuuugucggcgaacauggaucuagugcacggugguucaugauuaaguucgugacuagauuucaugcucgucuauuaaguugggucag

SEQ ID NO: 5174 - RNA, 215 nt, Drosophila melanogaster
uuauggauccucuuucaaugaauuuaguaugcccaaacucgaaggaguuucaccuccauaagagcgacaguccuggagaaguuaucagagccaaaaaaauucauaugaugaugcauuuuccgucucugaaaacgucuucagcagaaguuguuuuuagcgaagugaaacucauucgauuuugaucauacuaacgacauuggaugcuuggaucggca

SEQ ID NO: 5175 - RNA, 143 nt, Drosophila melanogaster
ccucgugucaaauucauuuuggaacugaauucucgugggucugcacugacaacacugaccgcuccagggcaaauuguucauuuugaaauugaaauucuguagcaccaugagauucagcucuggcgugaauuucaaacaugcau

SEQ ID NO: 5176 - RNA, 105 nt, Drosophila melanogaster
aaggaugccgcucaauuaccccgacauagucauacggugaauguuguguauuggagaccaauguuaacuguaagacugugucucggugguugccagcccagccac

SEQ ID NO: 5177 - RNA, 100 nt, Drosophila melanogaster
gacgcuugccauugauauuguccugucacagcaguauuguaacacuauauuauaguuuacugcugggucggggcauuaacauuguugagcgucauuagca

SEQ ID NO: 5178 - RNA, 90 nt, Drosophila melanogaster
aagcuggccugucccuggguaaacucccaaggaucagguggagauugaaucccgauccuuggguuucugcucucgggcaaggucaguagu

SEQ ID NO: 5179 - RNA, 89 nt, Drosophila melanogaster
uagaaauuauauauuuaaguaguggauacaaagggcgauuugauauaaaagugucgcauuguaugaccuacuuaacuagcugauuuugu

SEQ ID NO: 5180 - RNA, 56 nt, Drosophila melanogaster
guggguaucuggaugugguuggcucuggcgguccucucacauuuacauauucacag

SEQ ID NO: 5181 - RNA, 68 nt, Drosophila melanogaster
guugggggacauugaucucggagacggcgguuuaacugauccauucucucacaucacuucccucacag

SEQ ID NO: 5182 - RNA, 61 nt, Drosophila melanogaster
gugaguugaucgauuucgagguuuuggcacacgaauauaaucuggaaucuuuaauucgcag

SEQ ID NO: 5183 - RNA, 64 nt, Drosophila melanogaster
gugaguuugaaauugaaaugcguaaauuguuugguacaauuuaaauucgauuucuuauucauag

SEQ ID NO: 5184 - RNA, 65 nt, Drosophila melanogaster
guaagcaguguuugaacucgaucuugguucuuggacucuugauaagcucaauuaacuguuugcag

SEQ ID NO: 5185 - RNA, 57 nt, Drosophila melanogaster
guaaauaucuaaaguugaacuuggccaauggcaagucacagcuuuuuguguuuacag

SEQ ID NO: 5186 - RNA, 61 nt, Drosophila melanogaster
guaaguguaagacuuucuugaguuacccgcgaugaguaucucaaaaauuguuacauuucag

SEQ ID NO: 5187 - RNA, 71 nt, Drosophila melanogaster
guaagugguguagaugaaacaaauuuaccaacaauuuuguuggauuguuucaccuaucguuccauuugcag

SEQ ID NO: 5188 - RNA, 54 nt, Drosophila melanogaster
gugaguuuuugagccaggaauauaguucuuauuauugguucaaaucgcucgcag

SEQ ID NO: 5189 - RNA, 59 nt, Drosophila melanogaster
guggguagaacuuugauuaauauugcuugaaaaauauuagucaaagauuuuccccauag

SEQ ID NO: 5190 - RNA, 61 nt, Drosophila melanogaster
gugaguuucguacacuuaauuaauaggaucggccguuaauaaaaguaugccgaacucgcag

SEQ ID NO: 5191 - RNA, 68 nt, Drosophila melanogaster
guauaauggaaauagauuuuaaucgcaggcgcgucagugguugaauuaaaauucauuuucauuugcag

SEQ ID NO: 5192 - RNA, 64 nt, Drosophila melanogaster
gugagugaugcuccaguuagcuuggcugagugaggauuuaaguccugggacaucucucuugcag

SEQ ID NO: 5193 - RNA, 58 nt, Drosophila melanogaster
guaaguauagagaggaugugauugguaaauuccaaaguucaccucucuccauacuuag

SEQ ID NO: 5194 - RNA, 71 nt, Drosophila melanogaster
gugaguuuaguggaguuuaaagcuucccaucgccagcaauuacgcgaaagcucuacccaaacucauccccc

SEQ ID NO: 5195 - RNA, 113 nt, Drosophila melanogaster
cgggagaggauuaugaaagacaauuugaaauuaaauaucugugugugaaauuauuuaaaagauuaauuucacgcgaagauauuuauuuuuacauuugucccuauaauaaccgg

SEQ ID NO: 5196 - RNA, 115 nt, Drosophila melanogaster
ucguuuaagaugcugugaauaucccguuuucuuagcuuggcaauaaaauauuauucacagaaacuaguaauuuacuuccaagcuaacugaaggggauauucagugcaaccacgga

SEQ ID NO: 5197 - RNA, 103 nt, Drosophila melanogaster
ggaugucgagcaguacacguauuaucugcagcugcagaugcaaauguauauguaucuguaucuguaucugcaguauugcaguaucgcugcuuuauucauaucc

SEQ ID NO: 5198 - RNA, 107 nt, Drosophila melanogaster
gccugcauaacgcuguggcuuuccgcuucuauuuuucguucacugccuugugcuucguuggaaaaucggugagcuaaaaauagaauucgguugccacgcuucaaggg

SEQ ID NO: 5199 - RNA, 76 nt, Drosophila melanogaster
agcugcuccgaaaauaucaugaauacgacaauuaugugcacaucauuuaguauacgugauauuuuaggagcagcua

SEQ ID NO: 5200 - RNA, 95 nt, Drosophila melanogaster
gcaauaaguuagacgugaguauggcuauacaaaucaucuggaacguaaguucuaauguauguauuguauguuguauuugcaguuuuaugauagca

SEQ ID NO: 5201 - RNA, 75 nt, Drosophila melanogaster
gagcgaguugaagcgauaaagcagguugcaaacugcucucucgcuuugcucuuacuuuaucgcuuaaacucgcaa

SEQ ID NO: 5202 - RNA, 144 nt, Drosophila melanogaster
cgcgaaccacuuugugccgcuguugccuuugcaguugcuguuuuccauguugcuacugcggccaauuguugcgcaucagcaacaucaacaacaucaacaacagcagcagcaacugcaguagcagcacucgugauucacuuucga

SEQ ID NO: 5203 - RNA, 76 nt, Drosophila melanogaster
gaauuuuuuugggaucucuuuauaaagcguuuauuauuuauuuauuauguuuugucgagagcuuucaaaaaauuca

SEQ ID NO: 5204 - RNA, 106 nt, Drosophila melanogaster
cgcuauuauuaaaacccccaacgcucacacacacacacagccaugugcauggagcaaaaaacuauggccguguguauuugugcgaggcguuggcguucugaccagc

SEQ ID NO: 5205 - RNA, 117 nt, Drosophila melanogaster
uccaucuuccgaccggcgaucaguaagugcaccagauugggaauaaccuucaaaagcugcaacuuaaauauucccaguaauguccacuuacaaggagccccugguuggaugggugga

SEQ ID NO: 5206 - RNA, 115 nt, Drosophila melanogaster
uguaugaucacauuggcuugugggcguggcacuucaauugggcugacuuugccuggcuggaaaagcggcaccuaauugaaaugcccgccgaucagugcucgauuacgaucgacac

SEQ ID NO: 5207 - RNA, 118 nt, Drosophila melanogaster
gugcgccggugugcgugugugagaggccaucguaaaagccuuguuugcgugcggaauuuaacuguuuucucgccgucugcgaauugcggggcacucacacacgcauauucagccgcac

SEQ ID NO: 5208 - RNA, 96 nt, Drosophila melanogaster
gcacgucaucguaagcauugcaaaauguaguuguuaaauucgcucuucaaucauuaacaacauuuacaauguuugcaggcugucaacguugauggc

SEQ ID NO: 5209 - RNA, 112 nt, Drosophila melanogaster
cacauuugccauaaucuccuuaaaauaguaaaggcuguuaugcuuauuuuuguguuuuuuacaaaacuggcauucccgucuuacuuauuuucagaaaacuuacaccaaagug

SEQ ID NO: 5210 - RNA, 96 nt, Drosophila melanogaster
uccuugcugugggugugguugcgugcguagacgucagcgcaaugccuuuguuuggcggcaugcggaugacauucacguccguauccgcacacacau

SEQ ID NO: 5211 - RNA, 68 nt, Drosophila melanogaster
guaaggaacacacauauacaauaccguuugaauuucaaauaaucaggauuuuguguguggaccucaga

SEQ ID NO: 5212 - RNA, 71 nt, Drosophila melanogaster
guaaguuuggagugccugggcuaagaacuuccauucugaaacuuaacucuugcaaucaaacuuucuuucag

SEQ ID NO: 5213 - RNA, 71 nt, Drosophila melanogaster
guaagugacuaugccgggauugugguuauugaacuuagcgucuccacucacggcauuucauucacuugcag

SEQ ID NO: 5214 - RNA, 69 nt, Drosophila melanogaster
gugaguguccuguuuacagcugguauauuuuucgaaaagcccucuaaacuggucacuuccacucuacag

SEQ ID NO: 5215 - RNA, 76 nt, Drosophila melanogaster
gugagugggucgcacggagcgucauuuggaauucccauggcugacgaaacguucacucugcucuucucgauuacag

SEQ ID NO: 5216 - RNA, 68 nt, Drosophila melanogaster
gugaguuuaucuaaauaugcccauuuaucaauagucauacuuauuuaugcuccuuuaacuccuugcag

SEQ ID NO: 5217 - RNA, 61 nt, Drosophila melanogaster
gugagugauuaugguuuaaguaauacgaauuacauaaacuauauuuaaccacuauucuuag

SEQ ID NO: 5218 - RNA, 137 nt, Drosophila melanogaster
gugagugcaggcuguuuauugcggcgcuguuuacuguuuacgaucgcacuggaagugcgcuuuccggcgccuuuggaagccagcacucaaguuuccuucauuguuuuccuuucuuuccccucucucucuccccgcag

SEQ ID NO: 5219 - RNA, 59 nt, Drosophila melanogaster
guaggauuuuaagcauuaagcauguauauaguuuuugcugugcucauaaaguucuauag

SEQ ID NO: 5220 - RNA, 60 nt, Drosophila melanogaster
guagguugaaaucggauacaacuaaaaguuauuuuuaauuguauccggucuucauuuuag

SEQ ID NO: 5221 - RNA, 66 nt, Drosophila melanogaster
guuuguauggaauuccaugagcuucaaaguaaugcuucuaacucugugguuuuucauauuucccag

SEQ ID NO: 5222 - RNA, 68 nt, Drosophila melanogaster
gugaggaggagcaaaguggcgccacaauuuacuagaaacuaauugcaucuuuuuguccccccgcguag

SEQ ID NO: 5223 - RNA, 60 nt, Drosophila melanogaster
gugaguagucguauguuuauuaagauuuacuuucuauaaauuaauguccacuacuuuuag

SEQ ID NO: 5224 - RNA, 58 nt, Drosophila melanogaster
gugaguucgauuggaaaauuuaaauuuaauguuuaauuaaccaauucgaauugcuuag

SEQ ID NO: 5225 - RNA, 94 nt, Drosophila melanogaster
gugagugagagcgaguuccaaugugguccucgaaaccaguugugcuucgaucagauuccaaaauugacacauuccgaccuugaaucacccacag

SEQ ID NO: 5226 - RNA, 118 nt, Drosophila melanogaster
gugagaaaaaguaguaaauuaagcauaucacgcaaggacaaacauuaaguuaaggccuaguuccuauuauacuaggaauacucaauccuacuuaugccucuuauucuucuuuucucag

SEQ ID NO: 5227 - RNA, 59 nt, Drosophila melanogaster
guggguguucuuggaaauucgccucgaucgguagcuaaauuucugauuacuccuaaaag

SEQ ID NO: 5228 - RNA, 77 nt, Drosophila melanogaster
gugaguagcgaugggggucagauggccguggaagauaugugacgauugcccccuuacuacuaucgucugcucaacag

SEQ ID NO: 5229 - RNA, 55 nt, Drosophila melanogaster
gugagcacgauggccacauuuauugggcaaccaaugaauucccgccugcccacag

SEQ ID NO: 5230 - RNA, 60 nt, Drosophila melanogaster
gugagucucuaggggauuagcaagcuauaauuucucacuuaaucccugaacgacuugcag

SEQ ID NO: 5231 - RNA, 109 nt, Drosophila melanogaster
gcaucaugcuucugcgaucucuaccaauuuuccuugcacucuuuguccuuuccaaaagugacacgggugcaggugaagauucggaagaggacgacgaaaacgacugcaa

SEQ ID NO: 5232 - RNA, 105 nt, Drosophila melanogaster
uuaucgcaacuuaucgaucggguggcggauauagaucauugguuaucccuuaauuaaagcaaacaagauuuguuucggccgcccgauuuuacauacaacgacacg

SEQ ID NO: 5233 - RNA, 103 nt, Drosophila melanogaster
augaccggcgaggagaugcgauuccucgagcugcucaccgccuuuggcuuggacaucgaggcgguggccgccgcucugggagucgauaugcacacgcucaaca

SEQ ID NO: 5234 - RNA, 110 nt, Drosophila melanogaster
uaugaauacauauauuuuuauguuugagucaacaucgaguugccgauguuuggaaaacaucgaugacaucgcuguuggcaucgaaauauguccauaucuaauauauaguu

SEQ ID NO: 5235 - RNA, 117 nt, Drosophila melanogaster
uucggaucguuugaaugaccaauuuugucuuuuauuuucucuguguuuucaguuaaugaaagauagugaacacagugcuaaaugaaagauaaugagacccagucgacaggacccaag

SEQ ID NO: 5236 - RNA, 129 nt, Drosophila melanogaster
aaaaguaacuuucguaaucgaaaaaguuucgcuuuuuuuucugcuucugccgcugagcaaguuuuaaauauuaccgcuuaguuacagcugcaggaagaaaaguuauaauuauggacuacguacauaaau

SEQ ID NO: 5237 - RNA, 115 nt, Drosophila melanogaster
gugauggugcuggugguggugccuucauuguuuuucucuucuuuuuguuguuugacuuuuacacuuuugaacaacaagccgaaaggaaaaagcaugaaggaaugcaaaguauucg

SEQ ID NO: 5238 - RNA, 116 nt, Drosophila melanogaster
gcucgauugcugcaacuaagaaacaaauauuuucaguuguucauugcaaauuaauuuauguacauugcuaugaaaucaauugaaaauauaauuguauccuaggcuuaucagcugca

SEQ ID NO: 5239 - RNA, 100 nt, Drosophila melanogaster
aaagcgacccacccauuccccuuccgcccauauuuauccuucgucuacuguuucaucgcaggauuuaagugggcggagcacggaauucgggggcguggcg

SEQ ID NO: 5240 - RNA, 106 nt, Drosophila melanogaster
gucguagaugugggcguagguggcggcgggcguggcgugcgugauccugguuguggugaccacgccggugcgcuugcccuccuucugggcccacuccaugacgcuc

SEQ ID NO: 5241 - RNA, 99 nt, Drosophila melanogaster
auaaugcgccgccaucuugcggcacacucgcacacacacacgugugccauucugguuuugcaguggugugcgugugugccucgagucguugcgucacug

SEQ ID NO: 5242 - RNA, 92 nt, Drosophila melanogaster
uaaugcacauaauaaaugccaaccauucaucaugaaauuauaaauaguaucauuucaagaugcaugguaaggcuuuauuuuguuuugcaauc

SEQ ID NO: 5243 - RNA, 150 nt, Drosophila melanogaster
uuuucguacguacaaaaaagcaucagguuuucgggugagguuucugaugcuuugucucuuaaguuuuuccuaacaauuaaacccuaugucgguauuacgaauaccaucaaaaaaccucacccaccaaauguaugaccagagagauaaaaa

SEQ ID NO: 5244 - RNA, 126 nt, Drosophila melanogaster
uccgggugcgcuggacgaucugaucuucucgggagccggauccggaugucgcggcgacgacgaggacgagugcacgccgccauucgaaucggguagcggggaugaucucauaacaccggucuacgu

SEQ ID NO: 5245 - RNA, 93 nt, Drosophila melanogaster
uaaaguucacaggcgaccaugaauguuaauaaagaauauuuaccaauaaaguuuuauuuuuuauugaaggucauggacauccuugaaccgauu

SEQ ID NO: 5246 - RNA, 91 nt, Drosophila melanogaster
uuggcgcuuggaaucgauacccgagccaugauagauugaagucaacccaaucgaucgcgguucgagugcucgagucuugugcgccggcaug

SEQ ID NO: 5247 - RNA, 169 nt, Drosophila melanogaster
caccgauuugcuuccccuuuuuccgugcgcggagaaaaaaauccccagaaacauaauaucaggaugcucucuaucucugucucugucuaacgcuuaauuguugcucaauugcgaauuaaugucuggggcuuuuuuucuccgugcagugccauagccguaaccacaaccu

SEQ ID NO: 5248 - RNA, 117 nt, Drosophila melanogaster
agggggcggcaacaugugccaccugccgccgauggccagcaacaacucgcugaauaaucucugcggauugucgcugggcagcggugguagugaugaucucaugaacgauccucgggc

SEQ ID NO: 5249 - RNA, 84 nt, Drosophila melanogaster
ucguuguauuuuacgcacucugcuggcagcgcugucggcgucgcugccagcugccagcagcgagcgguacacuugcaacuaucc

SEQ ID NO: 5250 - RNA, 134 nt, Drosophila melanogaster
ucucuggcagcugcaguuccguuuccggagcgggaucuggaacgggcucugguucuagaucaggauccaaucaugcacccgguccagguaccgcuccaggucccguucccggaaacggugccaccgccaaugca

SEQ ID NO: 5251 - RNA, 118 nt, Drosophila melanogaster
uguccgguuugaaccuucugugccggcuggccaugauuugcagcagguaucuccgagagcagaugauacgcagccaguugcguuucaugaccaaacggcaugugaagcgugcccugcg

SEQ ID NO: 5252 - RNA, 101 nt, Drosophila melanogaster
acacaaggccugccgcccaagaaacgcaagcccagaaguccggcagucgagaaucacgagggacugggaccuugggcuuacgguucucaguuuggcuugac

SEQ ID NO: 5253 - RNA, 133 nt, Drosophila melanogaster
cgauauccaauaguagccaacucucucgcucucuauguguauguauguaucuugcuauccauauauguauauccauaucagagagccaggauugguugagaccauacgauauaacccgaaaccacacuggcca

SEQ ID NO: 5254 - RNA, 124 nt, Drosophila melanogaster
uccuuucuuuucucuccgucucucucuuucccucucucuguuuacauugagcuguuuuguccgugcacgugcuagacgauguagagagugagggagagagcgaauagaauaacagcucauugug

SEQ ID NO: 5255 - RNA, 109 nt, Drosophila melanogaster
cuguaggaaauuuuuugggguacuucugguuucauaacgcagagaaucaucagcgugaaggaaugauucucugcgggcuggaaccagaaguccugcaaauguucuuuua

SEQ ID NO: 5256 - RNA, 112 nt, Drosophila melanogaster
auuuuugaaugguccuuuucaugcccaaggcgaauaaauauguauuuauguauauuuuuuuauaugguacguauuuauuugucugcaaauggcugccaaggagugcuacaua

SEQ ID NO: 5257 - RNA, 87 nt, Drosophila melanogaster
cacaaggugaucgaugggagaugagcgccugaugugaugaugaaguagaucgaucacaccacacacucacucacccagguuucaucc

SEQ ID NO: 5258 - RNA, 127 nt, Drosophila melanogaster
gcugugugacaacaaacuugucggcacuggaguacuaaauauauugcacauguucaugcauguucaacauauuuagcacucaaguaccgaaaaaugaacaacgaaacgaaaaauaacacgaacauca

SEQ ID NO: 5259 - RNA, 107 nt, Drosophila melanogaster
cuauagcguugucucuugcgcaaauugcauuuucucucuguuaacauguacacauaauuccuguaacaaagggcauuugcaaugugugagucagcaaaccgcauccg

SEQ ID NO: 5260 - RNA, 155 nt, Drosophila melanogaster
uuuuccucagagccgcgacugcuggcguguuauuguugcuguugcagcuagcugccacgguuuguugcuucacugauuacgcgcaaugcagcaacagcagcagcagcagaagcaacagcaacuaacugcagaggagcaauagcagcugagaguuc

SEQ ID NO: 5261 - RNA, 158 nt, Drosophila melanogaster
guauggauuuuucggcguggcgguaaauugaaugaugagugggaggaugucgcugccauuguuugguugauaagggagccuggcgcacuauuaccuggcucucugaaacgagagcccaccugucaaucaauaccaccccgccgaugcgacaucaucau

SEQ ID NO: 5262 - RNA, 103 nt, Drosophila melanogaster
ccaaaggugggcgacaagggcugggagcagcaguugcuggcgguauucugaagcugcucuuccguggguugcucuugcuccugacccuccucuuccuccgcuu

SEQ ID NO: 5263 - RNA, 111 nt, Drosophila melanogaster
ucggcccucgacacgguggaugagcuugucaguggcggauccaggagcaauucugccgcuggcgacagaucaucggccacugacaaugcccauucacuguucgaggagauc

SEQ ID NO: 5264 - RNA, 107 nt, Drosophila melanogaster
aaucaaaagcgccguaggccuccaccucggcuuuacagauauauauauauauaucguguauauaucugugcgaucgggauugagacugagguugguccgaguacuuu

SEQ ID NO: 5265 - RNA, 151 nt, Drosophila melanogaster
cucguucagucgucguugcguguuguagguggccuggucuacugagcuccguuuggacugcuccuccuccaacuacuacugcggccgcugcugcugcugcugcggcugcugcauccgccugcaaccugcaacacucacaccacggcaacag

SEQ ID NO: 5266 - RNA, 102 nt, Drosophila melanogaster
uucuuuguuuuuauucccugucagagaguauauugauuuuagguggacauuugcgaccauauaaaauauauauauuccugauaaagaauauuuaauauaucu

SEQ ID NO: 5267 - RNA, 111 nt, Drosophila melanogaster
gggcaaauaaagcacguugcucccuguuuacuuggguuuucuguucauuucgccuaucgaacguugaacuuaaaaagccacgaucaguuguuuaacauacagauaucucug

SEQ ID NO: 5268 - RNA, 103 nt, Drosophila melanogaster
gucgaugccggcguuucccgcuccaggcugucguccauggaguuuguguugucagcauucagcucgguggaugucagccagcgguggaaggcgucgucucgcu

SEQ ID NO: 5269 - RNA, 105 nt, Drosophila melanogaster
uaacccuccgcucgagaacgugguuucuuuugcgacgugcaauacucuguggcagaagucuugcaccguuccaaaagagagcagcacguggagcgacgagaacgg

SEQ ID NO: 5270 - RNA, 147 nt, Drosophila melanogaster
ggacuuuccacuuuucguuuggcuggccuggaaaagcucucuuucucuauugccucuauggcucggcagcgcugggcgccuaauccgaauugcgagaaagauccgcuuuucgagccaaaaaccaucgaaaagccuggcaagcacaca

SEQ ID NO: 5271 - RNA, 109 nt, Drosophila melanogaster
cauagguguuauaucuaggccaaauauauauacuuguucuauguauuaguuauuugcaaaggaauacaugugccuguauauauauucgguaaaaucacaucuuugaauu

SEQ ID NO: 5272 - RNA, 122 nt, Drosophila melanogaster
gaagaggcugagagcgggaaagugagaaguagagagcgcagauagggagugggagcuuauaccguuauaaagccaacuuccguucugcguuucguuccaaccccccaccucucuuucccucu

SEQ ID NO: 5273 - RNA, 95 nt, Drosophila melanogaster
uggccacgugcccgcaagacgccuucggccggcgcaaaguuucaauuugauauuccuuggccggucgagcagcgucuugggguuguucguggauu

SEQ ID NO: 5274 - RNA, 119 nt, Drosophila melanogaster
ccaacuuugcuggcauucgguggccaauaaugcaauugcauguccuuguugcuguugcaauguugcagcuggaauugcaauugcauuucuaguugccgcugcugcugcucgaguggcaa

SEQ ID NO: 5275 - RNA, 108 nt, Drosophila melanogaster
ggcuggcugucuugacccacuugcucguuugcauuucugaaaaauguauacgcaaaaaccaaaaucagaaauucuuuugagcaagugugucaugaaauugccauucgu

SEQ ID NO: 5276 - RNA, 123 nt, Drosophila melanogaster
cuucgcucgaggugugaaaaccuuuuggccagcgaauacgccucggauccaaucacguuucaagaucgaggugaauucuuugacguauucgcuggccaaaugacacguucgccauguuuugcg

SEQ ID NO: 5277 - RNA, 101 nt, Drosophila melanogaster
uugggggcgcugcacuggcauugaaaagugaauuacauugaucgugacaugggaauggaaaaugucgccgagccauguaaaucguuuggccuacccgucua

SEQ ID NO: 5278 - RNA, 122 nt, Drosophila melanogaster
uucugccgcuuuugcuguggcuucucugcaugggauuccccauucugcauggcgccgaucucugccagcccaucggauggcggaacuuccagugcagcgaggucgcuucucugcaggaucug

SEQ ID NO: 5279 - RNA, 132 nt, Drosophila melanogaster
gcggugccguugaugaugacacagcgcgcuugcaacagcgugcggcacgauucucacagcagggcuccagcucggccaaaaaaucggucgucgccauugcaagcucaccguuuggucucaccacggccaaga

SEQ ID NO: 5280 - RNA, 68 nt, Drosophila melanogaster
ucguaaacguauacugaauguauccugaguguauccuauccgguauaccuucaguauacguaacacga

SEQ ID NO: 5281 - RNA, 68 nt, Drosophila melanogaster
ucguguuacguauacugaagguauaccggauaggauacacucaggauacauucaguauacguuuacga

SEQ ID NO: 5282 - RNA, 80 nt, Bos taurus; identical to SEQ ID NO: 1

SEQ ID NO: 5283 - RNA, 72 nt, Bos taurus; identical to SEQ ID NO: 2

SEQ ID NO: 5284 - RNA, 74 nt, Bos taurus; identical to SEQ ID NO: 3

SEQ ID NO: 5285 - RNA, 81 nt, Bos taurus
cggggugagguaguagguugugugguuucaggguagugauguugcccccucggaagauaacuauacaaccuacugccuucc

SEQ ID NO: 5286 - RNA, 84 nt, Bos taurus; identical to SEQ ID NO: 5

SEQ ID NO: 5287 - RNA, 87 nt, Bos taurus
ccuaggaagagguaguagguugcauaguuuucgggcagggauuuugcccacaaggagguaacuauacgaccugcugccuuucuuagg

SEQ ID NO: 5288 - RNA, 79 nt, Bos taurus; identical to SEQ ID NO: 7

SEQ ID NO: 5289 - RNA, 87 nt, Bos taurus; identical to SEQ ID NO: 8

SEQ ID NO: 5290 - RNA, 83 nt, Bos taurus; identical to SEQ ID NO: 9

SEQ ID NO: 5291 - RNA, 83 nt, Bos taurus
aggcugagguaguaguuuguacaguuugagggucuaugauaccacccgguacaggagauaacuguacaggccacugccuugcc

SEQ ID NO: 5292 - RNA, 84 nt, Bos taurus; identical to SEQ ID NO: 11

SEQ ID NO: 5293 - RNA, 76 nt, Bos taurus
gcuugggaaacauacuucuuuaugugcccauauggaccugcuaagcuauggaauguaaagaaguauguauuucagg

SEQ ID NO: 5294 - RNA, 85 nt, Bos taurus; identical to SEQ ID NO: 27

SEQ ID NO: 5295 - RNA, 98 nt, Bos taurus
guggagcagccagccccaucuggaagacuagugauuuuguuguugucuccugcgcucaacaacaagucccagucugccgcauggugcuggccaccgca

SEQ ID NO: 5296 - RNA, 109 nt, Bos taurus
uggauguuggucuaguucuguguggaagacuagugauuuuguuguuuuuagauaacugaaucgacaacaaaucacagucugccauauggcacaggccaugccucuacag

SEQ ID NO: 5297 - RNA, 82 nt, Bos taurus
agacuggagcgguuguggucuagugcuguguggaagacuagugauuuuguuguucugauguacuaugacaacaagucacagc

SEQ ID NO: 5298 - RNA, 90 nt, Bos taurus; identical to SEQ ID NO: 3430

SEQ ID NO: 5299 - RNA, 87 nt, Bos taurus; identical to SEQ ID NO: 281

SEQ ID NO: 5300 - RNA, 109 nt, Bos taurus
gaucugucugucuucuguauauacccuguagauccgaauuuguguaaggaauuuugugaucacaaauucguaucuaggggaauauguaguugacauaaacacuccgcuc

SEQ ID NO: 5301 - RNA, 99 nt, Bos taurus
cagugacguugucuauauauacccuguagaaccgaauuugugugguauccauguagucacagauucgauucuaggggaauauauggucgaugcaaaaac

SEQ ID NO: 5302 - RNA, 83 nt, Bos taurus; identical to SEQ ID NO: 77

SEQ ID NO: 5303 - RNA, 98 nt, Bos taurus
uugagaccuuaaaguacuguagcagcacaucaugguuuacauacuacagucaagaugcgaaucauuauuugcugcucuagaaauuuaaggaaauucau

SEQ ID NO: 5304 - RNA, 89 nt, Bos taurus
gucagcagugccuuagcagcacguaaauauugguguuaagauucuaaaauuaucuccaguauuaacugugcugcugaaguaagguuggc

SEQ ID NO: 5305 - RNA, 93 nt, Bos taurus
cauacuuguuccgcuguagcagcacguaaauauuggcguaguaaaauaaauauuaaacaccaauauuauugugcugcuuuagcgugacaggga

SEQ ID NO: 5306 - RNA, 84 nt, Bos taurus; identical to SEQ ID NO: 81

SEQ ID NO: 5307 - RNA, 71 nt, Bos taurus; identical to SEQ ID NO: 95

SEQ ID NO: 5308 - RNA, 75 nt, Bos taurus
cuuguguuaaggugcaucuagugcaguuagugaagcagcucagaaucuacugcccuaaaugcuccuucuggcaca

SEQ ID NO: 5309 - RNA, 82 nt, Bos taurus; identical to SEQ ID NO: 114

SEQ ID NO: 5310 - RNA, 87 nt, Bos taurus; identical to SEQ ID NO: 115

SEQ ID NO: 5311 - RNA, 83 nt, Bos taurus
acugcuacuuacaguuaguuuugcugguuugcauuucagcguguggauauauggcugugcaaauccaugcaaaacugauugug

SEQ ID NO: 5312 - RNA, 71 nt, Bos taurus; identical to SEQ ID NO: 128

SEQ ID NO: 5313 - RNA, 69 nt, Bos taurus
aguaccaaagugcucacagugcagguaguuuuggcagcgcucuacuguagugugggcacuuccaguacu

SEQ ID NO: 5314 - RNA, 72 nt, Bos taurus; identical to SEQ ID NO: 3096

SEQ ID NO: 5315 - RNA, 85 nt, Bos taurus; identical to SEQ ID NO: 144

SEQ ID NO: 5316 - RNA, 73 nt, Bos taurus
ggccggcugggguuccuggggaugggauuugcugccugucacaaaucacauugccagggauuuccaaccgacc

SEQ ID NO: 5317 - RNA, 60 nt, Bos taurus
ggguuccuggcaugcugauuugugacuuaagauuaaaaucacauugccagggauuaccac

SEQ ID NO: 5318 - RNA, 68 nt, Bos taurus; identical to SEQ ID NO: 152

SEQ ID NO: 5319 - RNA, 72 nt, Bos taurus
cucugccucccgugccuacugagcugaaacacaguugauuugugcacacuggcucaguucagcaggaacagg

SEQ ID NO: 5320 - RNA, 84 nt, Bos taurus
ggccaguguugagaggcggagacuugggcaauugcuggacgcugccccgggcauugcacuugucucggucugacagugccggcc

SEQ ID NO: 5321 - RNA, 90 nt, Bos taurus
aaggccguggccucguucaaguaauccaggauaggcugugcaggucccaaggggccuauucucgguuacuugcacgcggacgcgggccug

SEQ ID NO: 5322 - RNA, 84 nt, Bos taurus; identical to SEQ ID NO: 156

SEQ ID NO: 5323 - RNA, 85 nt, Bos taurus
ugcccgggacccaguucaaguaauucaggauagguugugugcuguccagccuguucuccauuacuuggcucgggggccggugccc

SEQ ID NO: 5324 - RNA, 90 nt, Bos taurus
caggcccgcguccgcgugcaaguaaccgagaauaggccccuugggaccugcacagccuauccuggauuacuugaacgaggccacggccuu

SEQ ID NO: 5325 - RNA, 78 nt, Bos taurus
uggccuggggagcagggcuuagcugcuugugagcagguccacaucaaaucguguucacaguggcuaaguuccgccccc

SEQ ID NO: 5326 - RNA, 97 nt, Bos taurus
accucucugacgaggugcagagcuuagcugauuggugaacagugacugguuuccgcuuuguucacaguggcuaaguucugcaccugaagagaaggug

SEQ ID NO: 5327 - RNA, 86 nt, Bos taurus
gguccuugcccucaaggagcucacagucuauugaguugccuuucugacuuucccacuagauugagagcuccuggagggcaggcacu

SEQ ID NO: 5328 - RNA, 64 nt, Bos taurus; identical to SEQ ID NO: 165

SEQ ID NO: 5329 - RNA, 81 nt, Bos taurus; identical to SEQ ID NO: 166

SEQ ID NO: 5330 - RNA, 81 nt, Bos taurus; identical to SEQ ID NO: 167

SEQ ID NO: 5331 - RNA, 88 nt, Bos taurus; identical to SEQ ID NO: 168

SEQ ID NO: 5332 - RNA, 88 nt, Bos taurus
aucucuuacacaggcugaccgauuucuccugguguucagagucuguuuuugucuagcaccauuugaaaucgauuaugauguaggggga

SEQ ID NO: 5333 - RNA, 81 nt, Bos taurus
cuucuggaagcugguuucacaugguggcuuagauuuuuccaucuuuguaucuagcaucauuugaaaucaguguuuuaggag

SEQ ID NO: 5334 - RNA, 67 nt, Bos taurus
cuguaaacauccucgacuggaagcugugaggcugcagaaaggcuuucagucggauguuugcagcugc

SEQ ID NO: 5335 - RNA, 88 nt, Bos taurus
ccaaguuuucaguucauguaaacauccuacacucagcuguaacacacgagucggcugggagguggauguuuacuucagcugacuugga

SEQ ID NO: 5336 - RNA, 105 nt, Bos taurus
cagacuguaaccaugccguaguguguguaaacauccuacacucucagcugugagcucgagguggcugggagaggguuguuuacuccuucugccauggaaaacguc

SEQ ID NO: 5337 - RNA, 70 nt, Bos taurus
guuguuguaaacauccccgacuggaagcuguaccacacagcuaagcuuucagucagauguuugcugcuac

SEQ ID NO: 5338 - RNA, 92 nt, Bos taurus
gggcagucuuugcuacuguaaacauccuugacuggaagcuguaaggcguugcaaggagcuuucagucggauguuuacagcggcaggcugcca

SEQ ID NO: 5339 - RNA, 84 nt, Bos taurus
gagggccagauacuguaaacacccuacacucucagcugugcacagugagaaagcugggagaaggcuguuuacucucucugccuu

SEQ ID NO: 5340 - RNA, 94 nt, Bos taurus
uccuguaacuuggaacuggagaggaggcaagaugcuggcauagcuguugaacugcgaaccugcuaugccaacauauugccaucucucuuguccg

SEQ ID NO: 5341 - RNA, 70 nt, Bos taurus
ggagguauugcacaugacuaaguugcauguugucacggccucagugcaauuuaguaugugugauauuuuc

SEQ ID NO: 5342 - RNA, 69 nt, Bos taurus
cugcggugcauuguaguugcauugcauguucuggcgguacccgugcaauguuuccacagugcaucacag

SEQ ID NO: 5343 - RNA, 94 nt, Bos taurus
gcgggcggccccgcggugcauugcuguugcauugcaugugugaggcaggugcagugccucggcagugcagcccggagccggccccuggcaccgc

SEQ ID NO: 5344 - RNA, 107 nt, Bos taurus
ggccagcugugaguguuucuuuggcagugucuuagcugguuguugugaguaauaaugcaggaagcaaucagcaaguauacugcccuagaagugcugcacguuguggg

SEQ ID NO: 5345 - RNA, 84 nt, Bos taurus
gugcucgguuuguaggcaguguaauuagcugauuguacucucaugcuuacaaucacuaguuccacugccaucaaaacaaggcac

SEQ ID NO: 5346 - RNA, 77 nt, Bos taurus; identical to SEQ ID NO: 3124

SEQ ID NO: 5347 - RNA, 78 nt, Bos taurus; identical to SEQ ID NO: 282

SEQ ID NO: 5348 - RNA, 68 nt, Bos taurus
uggguggggauuuguugcacugcuuguguuauauauaaaguauugcacuugucccggccuguggaaga

SEQ ID NO: 5349 - RNA, 96 nt, Bos taurus
cgggccccgggcgggcgggagggacgggacgcggugcaguguuguucuuuccccugccaauauugcacucgucccggccuccggcccccucggccc

SEQ ID NO: 5350 - RNA, 77 nt, Bos taurus
cugggggcuccaaagugcuguucgugcagguagugugaucaccugaccuacugcugagccagcacuucccgagcccc

SEQ ID NO: 5351 - RNA, 81 nt, Bos taurus
aacacagcgggcgcucaauaaauguuuguugaauugagaugcgcuaaauucaacggguauuuauugagcacccacucugug

SEQ ID NO: 5352 - RNA, 103 nt, Bos taurus
ccacuaccgucugcuuggccgacuuuggcacuagcacauuuuugcuugugucucuccgcucugagcaaucaugugcagugccaauaugggaaaagcaggaugc

SEQ ID NO: 5353 - RNA, 119 nt, Bos taurus
aggacucugcucaugcuggggugagguaguaaguuguauuguugugggguagggauuuuaggccccaauuugaagauaacuauacaacuuacuacuuucccugguguguagcacauuca

SEQ ID NO: 5354 - RNA, 81 nt, Bos taurus; identical to SEQ ID NO: 290

SEQ ID NO: 5355 - RNA, 70 nt, Bos taurus; identical to SEQ ID NO: 291

SEQ ID NO: 5356 - RNA, 76 nt, Bos taurus
ccuguugccacaaacccguagauccgaacuuguggugguagugcacacaagcuugugucuauagguaugugucugu

SEQ ID NO: 5357 - RNA, 83 nt, Bos taurus; identical to SEQ ID NO: 3488

SEQ ID NO: 5358 - RNA, 79 nt, Bos taurus; identical to SEQ ID NO: 14

SEQ ID NO: 5359 - RNA, 72 nt, Bos taurus
cugcccucggcuucuuuacagugcugccuuguugcauauggaucaagcagcauuguacagggcuaugaaggc

SEQ ID NO: 5360 - RNA, 76 nt, Bos taurus
uugugcuuucagcuucuuuacagugcugccuuguagcauucaggucaagcagcauuguacagggcuaugaaagaac

SEQ ID NO: 5361 - RNA, 81 nt, Bos taurus; identical to SEQ ID NO: 2819

SEQ ID NO: 5362 - RNA, 80 nt, Bos taurus
ugugcaucguggucaaaugcucagacuccuugguggcugcuuaugcaccauggauguuugagcaugugcuauggugucua

SEQ ID NO: 5363 - RNA, 81 nt, Bos taurus
ccuuggccauguaaaagugcuuacagugcagguagcuuuuugagaucuacugcaaugcaagcacuucuuacauuaccaugg

SEQ ID NO: 5364 - RNA, 80 nt, Bos taurus
ccugccggggcuaaagugcugacagugcagauagugguccugugugcuaccgcacuguggguacuugcugcuccggcagg

SEQ ID NO: 5365 - RNA, 81 nt, Bos taurus; identical to SEQ ID NO: 23

SEQ ID NO: 5366 - RNA, 85 nt, Bos taurus
ccuuagcagagcuguggagugugacaaugguguuuguguccaaacuaucaaacgccauuaucacacuaaauagcuacuguuaggc

SEQ ID NO: 5367 - RNA, 85 nt, Bos taurus; identical to SEQ ID NO: 29

SEQ ID NO: 5368 - RNA, 111 nt, Bos taurus
aucaagaucagacucugcccuccguguucacagcggaccuugauuuaaugucauacaauuaaggcacgcggugaaugccaagagcggagccuacaggcggcugcacuugaa

SEQ ID NO: 5369 - RNA, 87 nt, Bos taurus; identical to SEQ ID NO: 31

SEQ ID NO: 5370 - RNA, 86 nt, Bos taurus
ugccggccucugcgucccugagacccuuuaaccugugaggacguccagggucacaggugagguucuugggagccuggcguccggcc

SEQ ID NO: 5371 - RNA, 88 nt, Bos taurus
cgcgcgccucucaaucccugagacccuaacuugugauguuuaccguuuaaauccacggguuaggcucuugggagcugcgagucgcgcc

SEQ ID NO: 5372 - RNA, 85 nt, Bos taurus
gacuuuuccuagucccugagacccuaacuugugagguauuuuaguagcaucacaagucaggcucuugggaccuaggcggagggga

SEQ ID NO: 5373 - RNA, 73 nt, Bos taurus
ugacgggacauuauuacuuuugguacgcgcugugacacuucaaacucguaccgugaguaauaaugcgcuguca

SEQ ID NO: 5374 - RNA, 95 nt, Bos taurus
ugaucacugucuccagccugcugaagcucagagggcucugauucagaaagaucaucggauccgucugagcuuggcuggucggaagucuccucauc

SEQ ID NO: 5375 - RNA, 82 nt, Bos taurus; identical to SEQ ID NO: 37

SEQ ID NO: 5376 - RNA, 84 nt, Bos taurus
ugugcagugggaaggggggccgaggcacuguccgagagugaguagcaggucucacagugaaccggucucuuucccuacuguguc

SEQ ID NO: 5377 - RNA, 72 nt, Bos taurus
ggaucuuuuugcggucugggcuugcuguuccucucuacaguagucaggaagcccuuaccccaaaaaguaucu

SEQ ID NO: 5378 - RNA, 94 nt, Bos taurus
cugcccuucgcgaaucuuuuugcggucugggcuugcuguacauaacucaauagccggaagcccuuaccccaaaaagcauucgcggagggcgcac

SEQ ID NO: 5379 - RNA, 89 nt, Bos taurus
ugcugcgggccggagcucuuuucacauugugcuacugucugcgccugucacuagcagugcaauguuaaaagggcauuggcugugcagcg

SEQ ID NO: 5380 - RNA, 82 nt, Bos taurus
ggccugccugacacucuuucccuguugcacuacugugcgccccuggcaagcagugcaaugaugaaagggcaucggucaggcc

SEQ ID NO: 5381 - RNA, 101 nt, Bos taurus
ccgcccccgcgucuccagggcaaccguggcuuucgauuguuacugugggaaccggagguaacagucuacagccauggucgccccgcagcacgcccacgcgc

SEQ ID NO: 5382 - RNA, 95 nt, Bos taurus
ugggaccgaaugcuuugcuaaagcugguaaaauggaaccaaaucaacuguucgauggauuugguccccuucaaccagcuguagcugcgcauugau

SEQ ID NO: 5383 - RNA, 87 nt, Bos taurus; identical to SEQ ID NO: 2840

SEQ ID NO: 5384 - RNA, 84 nt, Bos taurus; identical to SEQ ID NO: 2841

SEQ ID NO: 5385 - RNA, 94 nt, Bos taurus
gccaucaaugcgcagcuacagcugguugaaggggaccaaauccaucgaacaguugauuugguuccauuuuaccagcuuuagcaaagcauucggu

SEQ ID NO: 5386 - RNA, 73 nt, Bos taurus
cagggugugugacugguugaccagaguggccagcacucgguucacccucugggccaccuagucaccaacccuc

SEQ ID NO: 5387 - RNA, 90 nt, Bos taurus
aggccucgcuguucucuauggcuuuuuauuccuaugugauucuacugcucacucauauagggauuggagccguggcgcacggcgggggca

SEQ ID NO: 5388 - RNA, 100 nt, Bos taurus; identical to SEQ ID NO: 49

SEQ ID NO: 5389 - RNA, 95 nt, Bos taurus
cucugcuguggccuauggcuuuucauuccuaugugauuacuguuccaaacucauguagggcuaaaagccaugggcuacagugaggggcgcgcgcc

SEQ ID NO: 5390 - RNA, 92 nt, Bos taurus
uuggaugagcccucggaggacuccauuuguuuugaugauggauucuuacgcuccaucaucgucucaaaugagucuucagaggguuccaucau

SEQ ID NO: 5391 - RNA, 102 nt, Bos taurus; identical to SEQ ID NO: 52

SEQ ID NO: 5392 - RNA, 97 nt, Bos taurus
cuggcacggugcgguggggcagcugguguugugaaucaggccgucgccaaucagagaacggcuacuucacaacaccagggucacaccccaccccagg

SEQ ID NO: 5393 - RNA, 83 nt, Bos taurus
guugcugcagcugguguugugaaucaggccgacgagcagcgcauccucuuacccggcuauuucacgacaccaggguugcauca

SEQ ID NO: 5394 - RNA, 68 nt, Bos taurus
guguacucuacagugcacgugucuccaguguggcucggaggcuggagacgcggcccuguuggaguaac

SEQ ID NO: 5395 - RNA, 94 nt, Bos taurus
ucucucuguguccugccagugguuuuacccuaugguagguuacgucaugcuguucuaccacaggguagaaccacggacaggauaccggggcacc

SEQ ID NO: 5396 - RNA, 90 nt, Bos taurus
gaccggcucuggguccaucuuccagcacaguguuggauggucuaauggugaagcuccuaacacugucugguaaagauggcccccggcugg

SEQ ID NO: 5397 - RNA, 87 nt, Bos taurus; identical to SEQ ID NO: 58

SEQ ID NO: 5398 - RNA, 101 nt, Bos taurus
gcguccugucucccagccugaggugcagugcugcaucucuggucaguugggagucugagaugaagcacuguagcucgggaagggagaaguuguucugcagc

SEQ ID NO: 5399 - RNA, 84 nt, Bos taurus
gggcccugacugggauaucaucauauacuguaaguuugcaacgagacacuacaguauagaugauguacuaguccgggugcuccc

SEQ ID NO: 5400 - RNA, 88 nt, Bos taurus; identical to SEQ ID NO: 61

SEQ ID NO: 5401 - RNA, 99 nt, Bos taurus
cccauguguauccucagcuuugagaacugaauuccauagguugugucagugucagaccugugaaguuuaguucuuuagcugggauaucucuaucauccu

SEQ ID NO: 5402 - RNA, 106 nt, Bos taurus
uaagagaacuuuggccaccuggcucugagaacugaauuccauaggcugugagcucuagcaaaugcccuagggacucaguucuggugcccggcugugcuacaccauc

SEQ ID NO: 5403 - RNA, 80 nt, Bos taurus
uaugaaucuaguggaaacacuucugcacaggcuagauuauggauaccagugugcggaaaugcuucugcuacauuuuuagg

SEQ ID NO: 5404 - RNA, 68 nt, Bos taurus; identical to SEQ ID NO: 3179

SEQ ID NO: 5405 - RNA, 90 nt, Bos taurus
uuagcauuugaggugaaguucuguuauacacucaggcuguggcucucugaaagucagugcaucacagaacuuugucucgaaagcuuucua

SEQ ID NO: 5406 - RNA, 90 nt, Bos taurus
gccggcgcccaggcucuggcuccgugucuucacucccguguguguccaccgagggagggagggacgggggcugugcuggggcggccggga

SEQ ID NO: 5407 - RNA, 100 nt, Bos taurus
ccucucuccucacggcccugucucccaacccuuguaccagugugugucucagacccugguacagguacggggaggcagggaccugggggaucccagcagc

SEQ ID NO: 5408 - RNA, 69 nt, Bos taurus
ccugcccucgaggagcucacagucuaguacgucucauccccuacuagacugaagcuccuugaggacagg

SEQ ID NO: 5409 - RNA, 86 nt, Bos taurus
uguccucccggcccagguucugugauacacuccgacucgggcucuggagcagucagugcaugacagaacuugggcccggacggacc

SEQ ID NO: 5410 - RNA, 90 nt, Bos taurus
cucacggcugccagcgucauuuuugugaucugcagcuaguauucucacuccaguugcauagucacaaaagugaucacuggcagguguggc

SEQ ID NO: 5411 - RNA, 87 nt, Bos taurus; identical to SEQ ID NO: 74

SEQ ID NO: 5412 - RNA, 84 nt, Bos taurus
gcggaacuugaagauagguuauccguguagccuucgcuuuacuugugacgaaucauacacgguucaccuauuuuuuaguaccaa

SEQ ID NO: 5413 - RNA, 81 nt, Bos taurus
guacuugaagagaggucuuccauggugcauucgcuuuauucuuugacgaaucauacaugguugaccuuuuuuuagguauca

SEQ ID NO: 5414 - RNA, 75 nt, Bos taurus
uucgaaaggagguuguccgugauguauuugcuuuauuuguggcagauauugcacgguugaucucuuuucuucauc

SEQ ID NO: 5415 - RNA, 63 nt, Bos taurus
uguuaaugcuaaucgugauagggguuuuuaccucggacugacuccuacauguuagcauuaaca

SEQ ID NO: 5416 - RNA, 110 nt, Bos taurus
ugagcuccgagguugcuucagugaacauucaacgcugucggugaguuuggaauuaaaaaucaaaaccaucgaccguugauuguacccuauggccaaccaccaucuccacc

SEQ ID NO: 5417 - RNA, 110 nt, Bos taurus
ugccagggccaggacccagucuucagaggacuccaaggaacauucaacgcugucggugaguuugggauuugaaaaaaccaccgaccguugacuguaccuuggguuccuua

SEQ ID NO: 5418 - RNA, 110 nt, Bos taurus
cuugggcagagguucuuucuuaaaaggucacaaucaacauucauugcugucgguggguugaacuguguggacaagcucacugaacaaugagugcaacuguggccccgcau

SEQ ID NO: 5419 - RNA, 89 nt, Bos taurus
cugauggcugcacucaacauucauugcugucgguggguuugacuuugaaucaacucacugaucaaugaauguaaacugcggaccaaaca

SEQ ID NO: 5420 - RNA, 97 nt, Bos taurus
uugccaaggguuugggggaacauucaaccugucggugaguuugggcagcucaggcaaaccaucgaccguugaguggaccccgaggccuggaacugcc

SEQ ID NO: 5421 - RNA, 113 nt, Bos taurus
uccccucccuuaggccacagcgaaggucacaaucaacauucauuguugucgguggguugugacagagaccagacccaccgagggaugaaugucacuguggcugggccagacac

SEQ ID NO: 5422 - RNA, 111 nt, Bos taurus
cgccgccgccugccucccaccauuuuuggcaaugguagaacucacacuggugagguaaugggauccggugguucuagacuugccaacuauggugcgagggcuuggccagca

SEQ ID NO: 5423 - RNA, 70 nt, Bos taurus
cuguguauggcacugguagaauucacugugaacagucucggucagugaauuaccgaagggccauaaacag

SEQ ID NO: 5424 - RNA, 83 nt, Bos taurus
ccagucacauccccuuaucacuuuuccagccagcuuugugacucuaacuguuggacggagaacugauaaggguaggugauuga

SEQ ID NO: 5425 - RNA, 79 nt, Bos taurus
gggggugagggacuggagagaaaggcaguuccugaugguccccuccccaggggcuggcuuuccuccggccccuccuucc

SEQ ID NO: 5426 - RNA, 86 nt, Bos taurus
ugcuuauaacuuuccaaagaauucuccuuuugggcuuucugauuuuauuuuaagcccaaaggugaauuuuuugggaaguuugagcu

SEQ ID NO: 5427 - RNA, 109 nt, Bos taurus
ggccgggcuccccacgacacggugugagaccucgggcuacaacacgggacccgggcgcugcuccgaccccucgugucuuguguugcagccggagggacgcaaguccgca

SEQ ID NO: 5428 - RNA, 86 nt, Bos taurus
ugcucccucucucacaucccuugcaugguggagggugagcuuucugaaaaccccucccacaugcaggguuugcaggauggugagcc

SEQ ID NO: 5429 - RNA, 85 nt, Bos taurus; identical to SEQ ID NO: 97

SEQ ID NO: 5430 - RNA, 79 nt, Bos taurus
ugcuucugugugauauguuugauauuggguuguuuaauuaggaaccaacuaaaugucaaacauauucuuacagcaguag

SEQ ID NO: 5431 - RNA, 91 nt, Bos taurus
ggcuggacagcgggcaacggaaucccaaaagcagcuguugucuccagagcauuccagcugcgcuuggauuucguucccugcucuccugccu

SEQ ID NO: 5432 - RNA, 106 nt, Bos taurus
agaccgagugcacagggcucugaccuaugaauugacagccagugcucuuguguccccucuggcugccaauuccauaggucacagguauguucgccucaaugccagc

SEQ ID NO: 5433 - RNA, 81 nt, Bos taurus
ugggagcugagagcugggucuuugcgggcgagaugaaggugucgguucaacuggccuacaaagucccaguccucggccccc

SEQ ID NO: 5434 - RNA, 53 nt, Bos taurus
auggcugccucacaagguuuggagcugugccugggacuuuguaggccaguuca

SEQ ID NO: 5435 - RNA, 83 nt, Bos taurus
guggucccagaaucgggguuuugagggcgagaugaguuuauguuuuauccaacuggcccacaaagucccgcuuuuggggucau

SEQ ID NO: 5436 - RNA, 97 nt, Bos taurus
uucuuaacggcgucaucgauuguaacagcaacuccauguggacugugcgucaauuuccaguggagaugcuguuacuuuugauggcugccaauucacu

SEQ ID NO: 5437 - RNA, 83 nt, Bos taurus
uggcucccacccccuguaacagcaacuccauguggaaguaccucuaguuccaguggggcugcuguuaucuggggugggggcca

SEQ ID NO: 5438 - RNA, 87 nt, Bos taurus
agcuccccuggcucuagcagcacagaaauauuggcacugggaagaaagccugccaauauuggcugugcugcuccaggcaggguggug

SEQ ID NO: 5439 - RNA, 102 nt, Bos taurus
ugaacuggaacugcugagugaauuagguaguuucauguuguugggccuggauuucugaacacaacgacauuaaaccacccgacucacggcaguuacugcucc

SEQ ID NO: 5440 - RNA, 85 nt, Bos taurus; identical to SEQ ID NO: 3573

SEQ ID NO: 5441 - RNA, 85 nt, Bos taurus; identical to SEQ ID NO: 3574

SEQ ID NO: 5442 - RNA, 81 nt, Bos taurus
ggggcugugccggguagagagggcagugggagguaagagcucuucacccuucaccaccuucuccacccagcagggccagca

SEQ ID NO: 5443 - RNA, 104 nt, Bos taurus
uggaagcuucuggagauccugcuccgucgccccaguguucagacuaccuguucaggacaaugccguuguacaguagucugcacauugguuagacugggcaaggg

SEQ ID NO: 5444 - RNA, 71 nt, Bos taurus
gccaacccaguguucagacuaccuguucagggggcucugaauguguacaguagucugcacauugguuaggc

SEQ ID NO: 5445 - RNA, 100 nt, Bos taurus
ccuccacuccgucuacccaguguuuagacuaucuguucaggacucccaaauuguacaguagucugcacauugguuaggcugggcuggguuagacccucgg

SEQ ID NO: 5446 - RNA, 76 nt, Bos taurus
aucagugguucuuacgguguguuugcuacuauugaaacgucaguguacaguagucugcacauuggcuucuugugau

SEQ ID NO: 5447 - RNA, 86 nt, Bos taurus
gggccucuguggacaucuuaccggacagugcuggauuucucggcucgacucuaacacugucugguaacgauguucaaaggugaccc

SEQ ID NO: 5448 - RNA, 59 nt, Bos taurus
ccaucuuacugggcagcauuggauggugucuggucucuaauacugccugguaaugauga

SEQ ID NO: 5449 - RNA, 65 nt, Bos taurus
cgucuuacccagcaguguuugggugcugguugggagucucuaauacugccggguaaugauggagg

SEQ ID NO: 5450 - RNA, 99 nt, Bos taurus
gccacucgcuguuccuuuuuccuaugcauauacuucuuugagggucuggccuaaagagguguagggcaugggaaaauggggccccgagguuccccugcg

SEQ ID NO: 5451 - RNA, 96 nt, Bos taurus
uuucuucaugugacucguggacuucccuuugucauccuaugccugagaauauaugaaggaggcugggaaggcaaagggacguucaauugucaucac

SEQ ID NO: 5452 - RNA, 69 nt, Bos taurus; identical to SEQ ID NO: 2903

SEQ ID NO: 5453 - RNA, 86 nt, Bos taurus
ugcuucccaaggccacaugcuucuuuauauccccauacggauuacuuugcuauggaauguaaggaagugugugguuucggcgagcg

SEQ ID NO: 5454 - RNA, 71 nt, Bos taurus; identical to SEQ ID NO: 126

SEQ ID NO: 5455 - RNA, 77 nt, Bos taurus; identical to SEQ ID NO: 3218

SEQ ID NO: 5456 - RNA, 98 nt, Bos taurus
ccuccaggcgcagggcagccacugcccaccgcacacugcgcugcuccggacccacugugcgugugacagcggcugaucugucccugggcagcgcgacc

SEQ ID NO: 5457 - RNA, 110 nt, Bos taurus
uccccuggcugugugaccugugggcuucccuuugucauccuuugcccaggguucugaguggggcagggacagcaaaggggugcucagucgucaccucccacagcauggag

SEQ ID NO: 5458 - RNA, 111 nt, Bos taurus
cggagccacccugcccgggcagcgcgccggcaccuuggcucuagacugcuuacugcccgggccgcccucaguaacagucuccagucacggccaccgacgccuggccccgcc

SEQ ID NO: 5459 - RNA, 110 nt, Bos taurus; identical to SEQ ID NO: 2911

SEQ ID NO: 5460 - RNA, 79 nt, Bos taurus
uguacaggaaaaugaccuaugaauugacagacaacgugacuaagucugucugucauuucuguaggccaauguucuguau

SEQ ID NO: 5461 - RNA, 109 nt, Bos taurus
gauggcugugaguuggcuuaaucucagcuggcaacugugagauguucauacaguccuccacaguggucucugggauuaugcuaaacagagcaaucuccuugcccucaug

SEQ ID NO: 5462 - RNA, 82 nt, Bos taurus
gcagacuggaaaaucucugcaggcaaaugugaugucacuaaagaaaucacacacuuacccguagagauucuacagucugaca

SEQ ID NO: 5463 - RNA, 110 nt, Bos taurus
aauauaauuaacacagaguuuuugaugucgcagauacugcaucaggaacugauuggauaagaaucggucaccaucaguuccucaugcauugccuucagcaucuaaacaag

SEQ ID NO: 5464 - RNA, 110 nt, Bos taurus
gugguuauguagcgagauuuucuguugugcuugaucuaaccaugugguugccagguaugaguaaaacaugguuccgucaagcaccauggaacgucacgcagcuuucuaca

SEQ ID NO: 5465 - RNA, 62 nt, Bos taurus
uuugugcuugaucuaaccaugugguggaacgauggaaacggaacaugguucugucaagcacc

SEQ ID NO: 5466 - RNA, 96 nt, Bos taurus
acucaggagcuucgccacugauuguccaaacgcaauucuuguacgagucugcggccaaccgagaauuguggcuggacaucuguggcugagcucugg

SEQ ID NO: 5467 - RNA, 63 nt, Bos taurus
ugauuguccaaacgcaauucucgagucucuagcucuggccgagaguugagucuggacgucccg

SEQ ID NO: 5468 - RNA, 110 nt, Bos taurus
ccaacauccaggucuagggcaugaaccuggcauacaauguagauuucuguguuuguugagcaacagcuacauugucugcuggguuucaggcuaccuggaaacacguucuu

SEQ ID NO: 5469 - RNA, 110 nt, Bos taurus
gcugcuggaauguguagguacccucaauggcucaguagccaguguagauccugucuuuuguaaucaguagcuacaucuggcuacugggucucugauggcaucuucuaccu

SEQ ID NO: 5470 - RNA, 108 nt, Bos taurus
cccagccuccugcagugccaugcuccguguauuugacaagcugaguuggacacuccauguaguagugucaguuugucaaauaccccaaguguggcauaugccuagcag

SEQ ID NO: 5471 - RNA, 81 nt, Bos taurus
gggcuuucaagucacuagugguuccguuuaguagaugguuguacauuguuucaaaaugguacccuagugacuacaaagccc

SEQ ID NO: 5472 - RNA, 78 nt, Bos taurus
aggacccuuccggagggccccccccaauccuguugugcuugguucagaggguugggcggaggcuuuccugaagggucu

SEQ ID NO: 5473 - RNA, 63 nt, Bos taurus
aagaaaugguuuaccgucccacauacauucugaauauguaugugggacgguaaaccgcuucuu

SEQ ID NO: 5474 - RNA, 85 nt, Bos taurus
acugcuaacgaaugcucugacuuuauugcacuacuguacuuuacagcuagcagugcaauaguauugucaaagcaucugaaagcag

SEQ ID NO: 5475 - RNA, 95 nt, Bos taurus
uccugcuggccgcaggugcucugacgagguugcacuacugugcuuugaggagcagugcaaugauauugucaaagcauccgggaccagccuuggag

SEQ ID NO: 5476 - RNA, 70 nt, Bos taurus
cccaccacuuaaacguggauguacuugcuuuauagcuaaaaaaguaagugcuuccauguuuuagugaugg

SEQ ID NO: 5477 - RNA, 75 nt, Bos taurus
cucccuuuaacuuuaacaugguaguacuuucugugacuuuugaaauaguaagugcuuccauguuuuaguagaagu

SEQ ID NO: 5478 - RNA, 68 nt, Bos taurus
ccucugcuuuaacauggggguaccugcuguguaaagcaaaaguaagugcuuccauguuucaguggagg

SEQ ID NO: 5479 - RNA, 70 nt, Bos taurus
ccucuacuuuaacauggaggcacuugcugugacuucauaaaaaaauaagugcuuccauguuuuagugcgg

SEQ ID NO: 5480 - RNA, 82 nt, Bos taurus
cccgcggcgucucgcuccccuccgccuucucuucccgguucuucccggagucgggaaaagcuggguugagagggcgaaaaag

SEQ ID NO: 5481 - RNA, 82 nt, Bos taurus
aaaaacgaaaaagaggccuucucuucccgguucuucccggagucgggaaaagcuggguugagagggcgaaaaaggaagaggg

SEQ ID NO: 5482 - RNA, 72 nt, Bos taurus
agagcaucaccggcccuccacagagcuuccugggccccuuagagcuggguugagagggugguccucgguucu

SEQ ID NO: 5483 - RNA, 86 nt, Bos taurus; identical to SEQ ID NO: 194

SEQ ID NO: 5484 - RNA, 89 nt, Bos taurus
aacuggcuaugccuccccgcauccccuagggcauugguguaaagcuggagacccacugccccaggugcugcuggggguuguagucugac

SEQ ID NO: 5485 - RNA, 95 nt, Bos taurus
cucgucugucuguugggcuggaggcagggccuuugugaaggcggguugugcucagaucgccucugggcccuuccuccagcccagaggcggauuca

SEQ ID NO: 5486 - RNA, 92 nt, Bos taurus
cuguuucggagccuggagcgggggggcaggaggggcucagggagauagugugugcugccccuggcccucucugcccuuccguccccuguucc

SEQ ID NO: 5487 - RNA, 83 nt, Bos taurus
gugguacuugaggagagguuuucuaggucucuguuucuuucaugaggaugaaacacaccugguuaaccuuuuuuccaguauca

SEQ ID NO: 5488 - RNA, 83 nt, Bos taurus
ugguaccugaagagagguuuucuggguuucuguuucuuuaaugaggaugaaacacaccugguuaaccucuuuuccaguaucaa

SEQ ID NO: 5489 - RNA, 94 nt, Bos taurus
cuucggcgaucacugccucucugggccugugucuuaggcucugcaagaucaaccgagcaaagcacacggccugcagagaggcagcgcucagcuc

SEQ ID NO: 5490 - RNA, 90 nt, Bos taurus; identical to SEQ ID NO: 2941

SEQ ID NO: 5491 - RNA, 92 nt, Bos taurus
uuuugggcgggggucaagagcaauaacgaaaaauguuugucauaaaccguuuuucauuauugcuccugaccuccucucauuugcuguacuca

SEQ ID NO: 5492 - RNA, 92 nt, Bos taurus
gcacgggccguccuccccaacaauauccuggugcugagugaugacacacgcaacuccagcaucagugauuuuguugaagagggcagcugcca

SEQ ID NO: 5493 - RNA, 78 nt, Bos taurus
ggggcagccgcugucccuguccuccaggagcucacuugguccggccgugcgcuccucgaggccagagcccgugucugc

SEQ ID NO: 5494 - RNA, 58 nt, Bos taurus
ucccuguccuccaggagcuccaggucugggguggguguggggauuucugcaggaggga

SEQ ID NO: 5495 - RNA, 95 nt, Bos taurus
uuguaccuggugugauuauaaagcaaugagacugauugucaugugucguuugugggauccgucucaguuacuuuauagccauaccugguaucuua

SEQ ID NO: 5496 - RNA, 94 nt, Bos taurus
uggaagcgggugcgaggcgaggggugcuaucugugguugaggacacggcaaaugaaacugucucacacagaaaucgcacccaucuccucggccc

SEQ ID NO: 5497 - RNA, 91 nt, Bos taurus
acccaaacccaggucugcugacuccuaguccagugcuugugauggcuggugggcccugaacuaggggucuggaggccuggguuugaauauc

SEQ ID NO: 5498 - RNA, 95 nt, Bos taurus
ggucucuguguugggcgucugucugcccgcaugccugccucucuguugcucugaaggaggcaggggcugggcuugcagcugccugggcagagcgg

SEQ ID NO: 5499 - RNA, 71 nt, Bos taurus
ggagcuuaucagaaucuccagggguacuuauaauuugaaaaagucccccaggugugauucugauuugcuuc

SEQ ID NO: 5500 - RNA, 65 nt, Bos taurus
cucgaauccuuggaaccuaggugugagugcuguucuagugcaacacaccuauucaaggauucaaa

SEQ ID NO: 5501 - RNA, 74 nt, Bos taurus
uguugucggguggaucacgaugcaauuuugauuaguauaauaggagaaaaauugcacgguauccaucugcgaac

SEQ ID NO: 5502 - RNA, 87 nt, Bos taurus
accgcagggaaaaugagggacuuuugggggcagauguguuugcauuccacuaucauaaugccccuaaaaauccuuauugcucuugca

SEQ ID NO: 5503 - RNA, 111 nt, Bos taurus
agagugcucgaggacagcaagaaaaaugagggacuuucaggggcagcuguguuuucugacucagucauaaugccccuaaaaauccuuauuguucuugcagugugcaucagg

SEQ ID NO: 5504 - RNA, 68 nt, Bos taurus
ccauuacuguugcuaauaugcaacucuguucaauucaaauuggaauugcacuuuagcaauggugaugg

SEQ ID NO: 5505 - RNA, 69 nt, Bos taurus
ugaagggagaucgaccguguuauauucgcuuuauugacuucgaauaauacaugguugaucuuuucucag

SEQ ID NO: 5506 - RNA, 75 nt, Bos taurus
aggcagagaagccaggucacgucucugcaguuacaccgcucacgagugccugcugggguggaaccuggucugucu

SEQ ID NO: 5507 - RNA, 79 nt, Bos taurus
cagccugugguacucaaacugugggggcacuuccguuuuacgaagggaagugccgccauguuuugaguguuaccgguug

SEQ ID NO: 5508 - RNA, 72 nt, Bos taurus; identical to SEQ ID NO: 3266

SEQ ID NO: 5509 - RNA, 95 nt, Bos taurus
gaagaaauccuacucggauggauauaauacaaccugcuaaguguccuagcacuuaucagguuguauuaucauuguccgugucuauggcucucguc

SEQ ID NO: 5510 - RNA, 64 nt, Bos taurus; identical to SEQ ID NO: 232

SEQ ID NO: 5511 - RNA, 99 nt, Bos taurus
aauccuucuuugguauuuaaaagguagauucuccuucuaugaguacauuauuuacgauuaaucauagaggaaaauccacguuuucaguaucaaaugcug

SEQ ID NO: 5512 - RNA, 93 nt, Bos taurus
uucuuugguauuuaaaagguggauauuccuucuauguuuacgugauucauagauaaucauagaggaaaauccauguuuucaguaucaaaugcu

SEQ ID NO: 5513 - RNA, 86 nt, Bos taurus
uuugguauuuaaaagguggauauuccuucuauguuuauguuauuugugguuaaacauagaggaaauuccacguuuucaguaucaaa

SEQ ID NO: 5514 - RNA, 82 nt, Bos taurus
gguauuuaaaagguagauuuuccuucuaugauuacggguuuggugauuaaucauagaggaaaauccacauuuucgguaucaa

SEQ ID NO: 5515 - RNA, 82 nt, Bos taurus
ugauauucaaaagguggauauuccuucuauguuuacaggauugacagcuaaacauagaggaaaauccacauuuuaaguaucu

SEQ ID NO: 5516 - RNA, 69 nt, Bos taurus; identical to SEQ ID NO: 237

SEQ ID NO: 5517 - RNA, 66 nt, Bos taurus; identical to SEQ ID NO: 3272

SEQ ID NO: 5518 - RNA, 76 nt, Bos taurus
ggagagcacuggacuuggagucagaaggcuggagcuuacagggcagcaccgucaucuacugguggagaacuacgcc

SEQ ID NO: 5519 - RNA, 98 nt, Bos taurus
cuggaccaccagggaaauccugauuuuguuucuuauuaaggggagguucaguauagagcaaacagcacuugacuuggagucagaaggcuuagguccaa

SEQ ID NO: 5520 - RNA, 69 nt, Bos taurus
caaaaccaccacuggacuuggagucagaaguuccaugugugagucuugguagggccaguggauugcuaa

SEQ ID NO: 5521 - RNA, 86 nt, Bos taurus
ugguuccugcagagaugguagacuauggaacguaggcuuugugauuuuugaccuauguaacaugguccacuaacucucaguaucca

SEQ ID NO: 5522 - RNA, 61 nt, Bos taurus
aagaugguugaccauagaacaugcgcugucucuaugucguauguaaugugguccacgucuu

SEQ ID NO: 5523 - RNA, 75 nt, Bos taurus
uacucagagcgagguugcccuuuguauauucgguuuuuugauguagaauauacaagggcaagcucucugugagua

SEQ ID NO: 5524 - RNA, 76 nt, Bos taurus; identical to SEQ ID NO: 252

SEQ ID NO: 5525 - RNA, 73 nt, Bos taurus
cuccucagaucagaaggugauuguggcuuuggguggauaucaaucagccacagcacugccuggucagaaagag

SEQ ID NO: 5526 - RNA, 79 nt, Bos taurus
ugguacgcggggagagguuacccgagcaacuuugcaucuggacgacgaauguugcucggugaaccccuuuucgguauca

SEQ ID NO: 5527 - RNA, 79 nt, Bos taurus
ugauaccgaaaagggguucaccgagcaacauucgucguccagaugcaaaguugcucggguaaccucuccccgcguacca

SEQ ID NO: 5528 - RNA, 81 nt, Bos taurus
ggguacuugaggagagguugucugugaugaguucgcuuuauuaaugacgaauauaacacagauggccuguuuucaguacca

SEQ ID NO: 5529 - RNA, 82 nt, Bos taurus; identical to SEQ ID NO: 3281

SEQ ID NO: 5530 - RNA, 75 nt, Bos taurus
uguggagagauggucgaccauaaaacguacgugugcuuuaugacguaugucacaugguccacuaauucucagcau

SEQ ID NO: 5531 - RNA, 74 nt, Bos taurus
gggaguggaugguugaucagagaacauacauuuugucaaugauguaugucaacugauccacagucccucccuau

SEQ ID NO: 5532 - RNA, 90 nt, Bos taurus
cugggguacaggacggauggucgaccaguuggaaaguaauuguuucuaauguacuucaccugguccacuagcuguccguacccacugcag

SEQ ID NO: 5533 - RNA, 85 nt, Bos taurus; identical to SEQ ID NO: 259

SEQ ID NO: 5534 - RNA, 94 nt, Bos taurus
auaaaggaaguuaggcugaggggcagagagcgagacuuuucuauuuuccaaaagcucggucugaggccccucagucuugcuuccuaccccgcgc

SEQ ID NO: 5535 - RNA, 96 nt, Bos taurus
ucguugacuccgaggggaugcagcagcaauucauguuuugaagugcuuuaaacgguucaaaacgugaggcgcugcuauacccccuugcgaggaagu

SEQ ID NO: 5536 - RNA, 87 nt, Bos taurus
gaaagcgcuuuggaaugacacgaucacucccguugagugggcacccaagaagccaucgggaaugucguguccgcccagugcucuuuc

SEQ ID NO: 5537 - RNA, 84 nt, Bos taurus
agccugccgaugggcgucuuaccagacacgguuagaucugguccuucugucuaauacugucugguaaugccguccauccccggc

SEQ ID NO: 5538 - RNA, 114 nt, Bos taurus
uccugcgcguccugcgaggugucuugcaggccgucaugcaggccacacugacggaaacguugcaggucgucuugcagggcuucucgcaagacgacauauucaucacccucgacg

SEQ ID NO: 5539 - RNA, 90 nt, Bos taurus
gcaugacuccuccaagucuuggaguaggucauuggguggauccuuuauuucccuaugugggccacuggauggcuccuccaugucuuggcg

SEQ ID NO: 5540 - RNA, 124 nt, Bos taurus
uggccggggagaaguacggugagccugucauuguucagagaggcuagauccuccuuguugagaaggaucaugaugggcuccucgguguucuccagguagcggcaccacaccaugaaggcagccc

SEQ ID NO: 5541 - RNA, 111 nt, Bos taurus
gcggggagguugaacauccugcauagugcugccaggaaaucccuauuuuauacuaaggggggguuggcugguugcauauguaggaugucccaucuccccacccacaucauc

SEQ ID NO: 5542 - RNA, 88 nt, Bos taurus
ugugugauggguuggcaguguauuguuagcugguugaauaugugagugccaucagcuaacaugcaacugcuaucuuauugcauguaua

SEQ ID NO: 5543 - RNA, 98 nt, Bos taurus
ugaccugaaucagguaggcaguguauuguuagcuggcugcuuugggucaauucagcagccacaacugcccugccacuugcuucuggauaaauucuucu

SEQ ID NO: 5544 - RNA, 106 nt, Bos taurus
augaagcuugaaugugucagguaggcagugcaucucuagcuggcuguuaaaauuucuuuuuaacaguugcuaguugcacuccccucuguugcauucauaaucuugc

SEQ ID NO: 5545 - RNA, 75 nt, Bos taurus
uguccuguccaugucgaaggcugugugcuguggaggggagccuucugggccgagagacacacgaccugggcugca

SEQ ID NO: 5546 - RNA, 82 nt, Bos taurus
acuauuuuugcgauguguuccuaauaugcaguauaaauauauugggagcauuuugcaugcaugguuuuguaucaauauacag

SEQ ID NO: 5547 - RNA, 92 nt, Bos taurus
caaagaaagaugcuaaacuauuuuugcgauguguuccuaauauguaaucuaaauguauugggaacauuuugcauucauaguuuuguaucaau

SEQ ID NO: 5548 - RNA, 86 nt, Bos taurus
aaaauuauuuuugcaauauguuccugaauauuuaauauaaguauauugggaacauuuugcauccauaguuuuguaucaguauuuag

SEQ ID NO: 5549 - RNA, 71 nt, Bos taurus
cuugggguggcgaggaaaccguuaccauuacugaguuuaguaaugguaacgguucucuugcugcacccaga

SEQ ID NO: 5550 - RNA, 85 nt, Bos taurus
gcuaagcacuuacaacuguuugcagaggaaacugagacuuuguaacuauaucucagucucaucugcaaagaaguaagugcuuugc

SEQ ID NO: 5551 - RNA, 80 nt, Bos taurus
gcgggaacgccaccagcagcacugccucacgguacuuggagggagguuguccguggugaguucgcauuauuuaaugaugc

SEQ ID NO: 5552 - RNA, 114 nt, Bos taurus
cuguuuauuaccagauccuagaacccuaucgauauugucucugcuguguaaauagcucugaguagugcaauauugcuuauaggguuuugguguuugggaagaacaaugggcaug

SEQ ID NO: 5553 - RNA, 89 nt, Bos taurus
ucccuggcgugaggguaugugccuuuggacuacaucguggaagccagcaccaugcaguccaugggcauauacacuugccucaaggccua

SEQ ID NO: 5554 - RNA, 68 nt, Bos taurus
ggggagggcgggaagaaaggagggcguggucugugcagcuccucacuccucuccucccgucuucuccu

SEQ ID NO: 5555 - RNA, 63 nt, Bos taurus
gucaggcucaguccccucccgauaaaccucuaaauagggaccuucccggggggcuaccucggc

SEQ ID NO: 5556 - RNA, 73 nt, Bos taurus; identical to SEQ ID NO: 3297

SEQ ID NO: 5557 - RNA, 124 nt, Bos taurus
gccagcuuggaccugcguccucccugacggguccuguacugagcugccccgaggcccuucgcugugcccagcucgggucagcucaguaccgggcgcgucggggugggagucggccggaagcagg

SEQ ID NO: 5558 - RNA, 80 nt, Bos taurus; identical to SEQ ID NO: 2994

SEQ ID NO: 5559 - RNA, 84 nt, Bos taurus
uugguacuuggagagugguuaucccuguccuguucguuuuacucaugucgaaucguacagggucauccacuuuuucaguaucaa

SEQ ID NO: 5560 - RNA, 96 nt, Bos taurus
gagaaucaucucucccagauaauggcacucucaaacagguuuccagguuguuugaaaggcuguuucuuggucagaagacucucaauuccuucugga

SEQ ID NO: 5561 - RNA, 82 nt, Bos taurus
guggcagcuugguggucguauguguggcgccaucuacuggaacguuuaggagugacaucacauauauggcgacuaaacugcu

SEQ ID NO: 5562 - RNA, 127 nt, Bos taurus
uggagacuugcugguuuggaaaguucauuguucgacaccauggaucuccaggugggucacguuuagagauacaccaaccuggaggacuccaugcuguugagcuguucacaagcagcggacacuucua

SEQ ID NO: 5563 - RNA, 84 nt, Bos taurus; identical to SEQ ID NO: 3304

SEQ ID NO: 5564 - RNA, 89 nt, Bos taurus
cuggcccccagggccuuguacaugguaggcuuucauucauucguuugcacauucggugaaggucuacugugugccaggcccugugccag

SEQ ID NO: 5565 - RNA, 85 nt, Bos taurus
ucgauacuugaaggagagguuauccguguugucuucucuuuauuuaugaugaaacauacacgggaaaccucuuuuuuaguaucaa

SEQ ID NO: 5566 - RNA, 81 nt, Bos taurus
uggugccuggaaagaaguugcccauguucuuuucgcugauaugugacgaaacaaacauggugcacuucuuuuccggcauca

SEQ ID NO: 5567 - RNA, 101 nt, Bos taurus
ccgagucggguacucgaauggagguuguccaugguguguucauuuuauuuaugaugaguauuacauggccaaucuccuuucaguacuaaauucuucauggg

SEQ ID NO: 5568 - RNA, 112 nt, Bos taurus
ccaccccaguccugcucccgccccagcagcacacugugguuuguacggcacuguggccacguccaaaccacacugugguguuagagcgagggugggggaggcaccgcugagg

SEQ ID NO: 5569 - RNA, 103 nt, Bos taurus
gggcgggcggccguuaagacuugcagugauguuuaacuccucuccacgugaacaucacagcaagucugugcugcuucccguccccacgcugccugggcagggu

SEQ ID NO: 5570 - RNA, 84 nt, Bos taurus
gcucccccucucuaauccuugcuaccugggugagagugcuuucugaaugcaaugcaccugggcaaggauucugagagagggagc

SEQ ID NO: 5571 - RNA, 85 nt, Bos taurus
ugcccaccccucuaauccuugcucucugggugcuagugcugucuccaugcaaugcaccugggcaaggauucagagagggugggcu

SEQ ID NO: 5572 - RNA, 90 nt, Bos taurus
cugcucuguuccccuguauccaaucuuaaugcccagaugcagguacugucucagugcaaugcaccugggcaaggauucacagaagauaag

SEQ ID NO: 5573 - RNA, 83 nt, Bos taurus
gcuccccucucuaauucuugcuccccaggugagagugcuuugugaaugcaauccaccugggcaaggauucugaaugugagagc

SEQ ID NO: 5574 - RNA, 83 nt, Bos taurus
agccgugcccuagcagcgggaacaguacugcagugggcaauuggugaucuggaguauuguuucugcugcccgggcaagacugg

SEQ ID NO: 5575 - RNA, 83 nt, Bos taurus
gcugcuguugggagacccuggucugcacucugucuguaugcuuacugaagggagcgcagggcaggguuucccauacagagggc

SEQ ID NO: 5576 - RNA, 90 nt, Bos taurus
aaauugaugcacccagugggggagccaggaaguauugauguuucuaccaguuuagcgucaacacuugcugguuuccucucuggagcguca

SEQ ID NO: 5577 - RNA, 86 nt, Bos taurus
gacuugcuuucucucuuacaugccuugaguguaggaccguuggcaucuuaauuacccucccacacccaaggcuugcaggagagcca

SEQ ID NO: 5578 - RNA, 78 nt, Bos taurus
auacuugaggagaaauuauccuugguguguucgcuuuauuugggaugaaucauacaaggacaauuucuuucugaguau

SEQ ID NO: 5579 - RNA, 84 nt, Bos taurus
acgucagggaaaggauucugcugucggucccacuccaaaguucaaaaaauggguggugggcacagaauccggccucugcuugug

SEQ ID NO: 5580 - RNA, 97 nt, Bos taurus
augcacagaccucagacaucucggggaucaucaugucacgagauaccacugugcacuugugacagauugauaacugaaaggucugggagccgcucau

SEQ ID NO: 5581 - RNA, 80 nt, Bos taurus
ggugcuuaaggagaaguugcccgugucuuuuucgcuuuauaugugacgaaacauucgcggugcacuucuuuuucaguauc

SEQ ID NO: 5582 - RNA, 91 nt, Bos taurus
auuuucaucaccuagggaucuuguuaaaaggcagauucugauucagggaccaagauucugcauuuuuagcaaguucccaagugaugcuaau

SEQ ID NO: 5583 - RNA, 85 nt, Bos taurus
ucaccuggauagcuuguuaaaaugcagauuccacuucagugggccugggauucugcauuucuaacaaguucccagguguugcgaa

SEQ ID NO: 5584 - RNA, 92 nt, Bos taurus
aucaccuggggaucuuguuaaaugagauucugguucgguaggaauggggccugagauucugcauuucuaacaaguucucaggugaugccacu

SEQ ID NO: 5585 - RNA, 106 nt, Bos taurus
cccagccuggcacauucguaggccucaguaaauguuuauuggaugaauaaaugaauggcucaucaacaaacauuuauugugugccugcuaacgugaucuccacagg

SEQ ID NO: 5586 - RNA, 95 nt, Bos taurus
ggggaccaccugcugacccugaaacccagagcaggugaggccugucugacuguuucugggcgacccaaucuugguuuccaugguugcccuggaaa

SEQ ID NO: 5587 - RNA, 95 nt, Bos taurus
agagaaguucuccuggccuaagaaaucaagcgugggugagaccuggugcagaacaggaaggcgacccauacuugguuucagaggcugugagaaua

SEQ ID NO: 5588 - RNA, 82 nt, Bos taurus
aguggaaaugcugguucauauggcaauucuaccuuuuaugaggaacuguaaggcuguuuuccaaagcagcuguaccauuuac

SEQ ID NO: 5589 - RNA, 94 nt, Bos taurus
auauacacuauauuauguauaaauguauacacacuuccuauauauauccauauauauauaguguauauauuauacauguauagguguguauaug

SEQ ID NO: 5590 - RNA, 67 nt, Bos taurus
uucuuuugagcuuacuucccagucucgaauccgugugagugugugugugugagugugugugagagug

SEQ ID NO: 5591 - RNA, 98 nt, Bos taurus
aucuguucucuuugguuacaguuguucaaccaguuacuaaucuaccuaauuguaaccaguugaacaacugaacccaaagggugcaaagugaaaacauu

SEQ ID NO: 5592 - RNA, 76 nt, Bos taurus
ucgggugaucaaccgucaugguuugccugggacugagggguuucuuggaaugcaaggcuuccagugcucaagccag

SEQ ID NO: 5593 - RNA, 89 nt, Bos taurus
uaggguguccaagcccugcugguuugccugggacugaggaguuucucaggcuaaagccaggaaaguucagggcaaaccagggugagcug

SEQ ID NO: 5594 - RNA, 85 nt, Bos taurus
uagggugaccaacuauccugguuugccugggacugagaaauuuccugggaugcagagcuuucaguacuauauagccuggacaguc

SEQ ID NO: 5595 - RNA, 76 nt, Bos taurus
gaccauccuccugguuugccugggacugagugguuuccugggucugugggacuuccagugcuuaaacugggcaggu

SEQ ID NO: 5596 - RNA, 95 nt, Bos taurus
agggaugaccaacuguccugguuugccugggacugagggguuacugaggacacgugaagucccugggcaaacuggagugguugguucauucuagc

SEQ ID NO: 5597 - RNA, 76 nt, Bos taurus
uuggaugaccaaucaucuugguuugccugggacugagggguuucccuggaugugggauguguugaagccaggcaug

SEQ ID NO: 5598 - RNA, 67 nt, Bos taurus
agggugaccaacugucuugguuugccugggacugaggguuuccugggaugugggauguuuaggacua

SEQ ID NO: 5599 - RNA, 88 nt, Bos taurus
aggauggccaagcauucugguuugccugggacugagugccugagguacgggacuugcagugccaagauuaggauguuguuguugcugc

SEQ ID NO: 5600 - RNA, 96 nt, Bos taurus
uauuaugccaugacauugugucaauaugcgaugaugugugugauggcacagcgucaucacguggugacgcaacaucaugacguaagacgucacaac

SEQ ID NO: 5601 - RNA, 95 nt, Bos taurus
aaagacgugcuguccacaguguguuugauaagcugacaugggacagggacucuuuucacuguugugucaguuuaucaaacccauacguggaugac

SEQ ID NO: 5602 - RNA, 93 nt, Bos taurus
cucgggaggggcgggagggggguccccggugcucggaucucgagggugcuuauuguucgguccgagccugggucucccucuccccccaccccc

SEQ ID NO: 5603 - RNA, 95 nt, Bos taurus; identical to SEQ ID NO: 541

SEQ ID NO: 5604 - RNA, 75 nt, Bos taurus
ggggagcccaguuagaccuggcuuagaccucagcuucacaagcugauagacugagucagggggccaaagcucucc

SEQ ID NO: 5605 - RNA, 98 nt, Bos taurus
acgaauggcuaugcacugcacaacccuaggagagggugccauucacauagacuagaauugaauggcgccacuaggguugugcagugcacaaccuacac

SEQ ID NO: 5606 - RNA, 90 nt, Bos taurus
ucauucccucaguguugaaacaaucucuguugaaccauguuacaggaaguucacuggaguuuguuucaacauuggaggaaugauaagaug

SEQ ID NO: 5607 - RNA, 81 nt, Bos taurus
ggguuaguggaaagguggugggcugcagaacaugugcuuccuucgugucauaugucugcugaccaucaccuuuagaagccc

SEQ ID NO: 5608 - RNA, 97 nt, Bos taurus
aacuguucagggauauuugaggagagguuauccguguuauguucgcuuggcucaucaugaauaauacaugguuaaccucucuuugaauaucagacuc

SEQ ID NO: 5609 - RNA, 79 nt, Bos taurus
cugaaauagguugccugugagguguucacuuuucuaagcgaugaauauuauacagucaaccucuuuccgauaucgaauc

SEQ ID NO: 5610 - RNA, 100 nt, Bos taurus
cccgguugccgugguugcaggcccggcccgccagcuuguccgcugacagcgagccauuagggcggagggaagcggguccguugguccuucaggcacgagg

SEQ ID NO: 5611 - RNA, 80 nt, Bos taurus
cugcuccuucucccguacccauugcauaucggagcugugaauucucaaagcaccuccuaugugcauggauuacaggaggg

SEQ ID NO: 5612 - RNA, 82 nt, Bos taurus
gggacauuaaaacacaggcugggguguguguggauggagacuguuacucuauucguuuacucccuagccuccagauaugccu

SEQ ID NO: 5613 - RNA, 60 nt, Bos taurus
caggcuaggagaaaugauuggauagaaaauuuuauucuauucauuuaucucccagccuac

SEQ ID NO: 5614 - RNA, 72 nt, Bos taurus
ucuccuugaggggucuuggccucugcccaggacucuuucaugaccaguaggccgaggccccucacaggcggc

SEQ ID NO: 5615 - RNA, 64 nt, Bos taurus
agagugugugggugugugcaugugcgugugugcacaugcauauguguguggcuaucuuagcugu

SEQ ID NO: 5616 - RNA, 99 nt, Bos taurus
gguuuagggguggaucugacgucccugaguauauguggugaaccggaauuugccugggguuuccucauauucauucaggagugucaguucucccugcgc

SEQ ID NO: 5617 - RNA, 118 nt, Bos taurus
gccgccgaccuggcaggccaggaagaggaggaagcccuggaggggcuggaggugauggauguuuuccuccgguucucagggcuccaccuuuuccgggccguggagccagggcuggugc

SEQ ID NO: 5618 - RNA, 66 nt, Bos taurus
cucacugaugagcagcuucugacuuucguucuucugaguuugcugaagccagaugccauuucugag

SEQ ID NO: 5619 - RNA, 109 nt, Bos taurus
cugugugugaagugguaacugcccucaaggagcuuacaaucuagcuggggguaaacgacuugcacaugaacgcaucuagacugugagcuucuagagggcagggaccuua

SEQ ID NO: 5620 - RNA, 100 nt, Bos taurus
gguugggcggggugcggggcuagggcuaacagcaggcucacugacgguuucccggaaaccacgcacaugcuguugccacuaaccucaaccuuacucgguc

SEQ ID NO: 5621 - RNA, 88 nt, Bos taurus
gccuggguacaugagaugguugaccagagagcacacgcuuuauuugugccguuugugaccugguccacuaacccucaguaucuaaucc

SEQ ID NO: 5622 - RNA, 96 nt, Bos taurus
ggauuauaauaaauuaaaugccuaaacuggcagacugcaaacaauuuugacuuagaucuaaauguuugcacuggcuguuuaaacauuuaauuuguu

SEQ ID NO: 5623 - RNA, 117 nt, Bos taurus
ggaggaugcugcagcguggggcgcgucgccccccucaguccaccagagcccggauaccuuagaaauucggcucugggucuguggggagcgaaaugcaacccaaacuccauuuugccg

SEQ ID NO: 5624 - RNA, 76 nt, Bos taurus
uggcaagaggaggagcagcagggugaaacugacacaguucuggugaguuucacuuugcugcuccuccagauucuca

SEQ ID NO: 5625 - RNA, 120 nt, Bos taurus
aaugauggaggugcaggcauuuccugaggauuaaugaccagcugggaggaaccaguggcccuuggcucugccucccagccagccauuaauuccgaggaaaugucuuuugcugaggucguu

SEQ ID NO: 5626 - RNA, 95 nt, Bos taurus
aaucuaguaggcaggugcucacucguccuucuccacgguuaaaaauacagggaggaggccagaauggcaacuaucacuaugauuguuuucuuugg

SEQ ID NO: 5627 - RNA, 105 nt, Bos taurus
uuuguauuauagguuuuugcucaugcaccaugguugucugagcaugcagcaugcuugucugcucauaccccaugguuccugagcaggaaccgucacugcuuacug

SEQ ID NO: 5628 - RNA, 119 nt, Bos taurus
gacuuggugcugauucccggcgcucugaccugagaccuccggguucugagcugugauguugcuucccagcugggaucucuggggucucgguucagggucgggaccucuggguucugagc

SEQ ID NO: 5629 - RNA, 77 nt, Bos taurus
gugugcauuugcaggaacuugugagucuccuauugaacaugaacaggaggcugaugaguucccgggaacacccacaa

SEQ ID NO: 5630 - RNA, 76 nt, Bos taurus; identical to SEQ ID NO: 3927

SEQ ID NO: 5631 - RNA, 77 nt, Bos taurus
uuagugggacuauaccucaguuuuaucagguguuauuuaaaaucaccuggaaauacugagguuguguuucacugaac

SEQ ID NO: 5632 - RNA, 81 nt, Bos taurus; identical to SEQ ID NO: 606

SEQ ID NO: 5633 - RNA, 102 nt, Bos taurus
gcucgagaagguagaggagauggcgcaggggacacgggcuaagacugggggcucccgggaccccccaacauguguccucuucucccuccucccagguguacg

SEQ ID NO: 5634 - RNA, 74 nt, Bos taurus
ccgcgcucucuccauuacacuacccugccucuucuccacgagaggcagcgggguguaguggauagagcacgggu

SEQ ID NO: 5635 - RNA, 91 nt, Bos taurus; identical to SEQ ID NO: 624

SEQ ID NO: 5636 - RNA, 93 nt, Bos taurus
guggggugugggcugggccccaggaguggggccugggcaacccuguguguugaggaaggaaggcugggcccccgcuccgcgggccugacccca

SEQ ID NO: 5637 - RNA, 90 nt, Bos taurus
ggccagaagggaagaagcauucuuucauugguugguguauguugccuugucaaccaaucagaggaugccauuuauccuuuucugacuagc

SEQ ID NO: 5638 - RNA, 86 nt, Bos taurus
uuugguacuugaagagaggauacccuuuguauguucacuuuauuaauggcgaauauacagagggagacucuuauuugcguaucaaa

SEQ ID NO: 5639 - RNA, 105 nt, Bos taurus
ccagccgcucuccaggguagcugaggggaugguaggccggugacgugcacuucauuuacgauguaggucacccguuugacuauccaccagcacccaguccaucug

SEQ ID NO: 5640 - RNA, 97 nt, Bos taurus
cuuccugguauuugaagacgcgguugaccaugguguguacgcuuuauuuaugacguaggacacauggucuacuucuucucgauaucacaucuucgcc

SEQ ID NO: 5641 - RNA, 86 nt, Bos taurus
gugaggacucgggagguggaggguggcgcugccagggccagggcacugucucagcucgcuucuccccccaccuccucucuccucag

SEQ ID NO: 5642 - RNA, 93 nt, Bos taurus
guggguacggcccagggggggagagggacgcacccugggcccagcagagcccagggcgcagccggacugaccgagccccugugccgcccccag

SEQ ID NO: 5643 - RNA, 73 nt, Bos taurus
caacauauuaaauggauuuuuggagcaggaaguuggaauagaggcuuucucagacaaauacuuuacugugcag

SEQ ID NO: 5644 - RNA, 78 nt, Bos taurus
cgccgggcgcacccgucccgugcguccccggacgucgcugucugccccgggaacgucgggacuggagcgcccgcgcug

SEQ ID NO: 5645 - RNA, 105 nt, Bos taurus
uuuaccuucuuguauaagcacugugcuaaaauuacagaaaccaagauagccuugguuuuuguaauaaugcuagcagaguauuacacaagaagaagaggaacugca

SEQ ID NO: 5646 - RNA, 105 nt, Bos taurus
uauaccuucuuguauaagcacugugcuaaaauuacagaaaccaagauagccuugguuuuuguaauaaugcuagcagaguauuacacaagaagaagaggaacugca

SEQ ID NO: 5647 - RNA, 65 nt, Bos taurus
gggaggagggaggagaugggccacguucccucugccuggaacgcccuucccccccuucuucaccu

SEQ ID NO: 5648 - RNA, 70 nt, Bos taurus
guggacucuagcugccaaaggcgcuucuccuucugaaccgagcgcuuugcucagccaguguagacauggc

SEQ ID NO: 5649 - RNA, 82 nt, Bos taurus
agucagccugugcuuugaagcuuugaagucaggcauugacuucucucuagauauuaaaguccuuagguagacauagguagau

SEQ ID NO: 5650 - RNA, 100 nt, Bos taurus
guugcugcugcucgccaucgaucccaccacugccaccacugcugcuacugcuccgcaggugcugcugguggugaugaugauaguccggcgggggcgcugg

SEQ ID NO: 5651 - RNA, 86 nt, Bos taurus
cacccagaucagugcuuggcaccuaguaaguacucaguauauacuuguugagugccugcuaugugccaggcauugugcugagggcu

SEQ ID NO: 5652 - RNA, 78 nt, Bos taurus
accucccaaauauauauauauauguacguauguguauaugaauguauacguagauauauauguauuuuugguggguuu

SEQ ID NO: 5653 - RNA, 54 nt, Bos taurus
agggggcaccgggaggaggugagugucucuugucgccuccuccucuccccgcuu

SEQ ID NO: 5654 - RNA, 101 nt, Bos taurus
ccuucuucucguuugccuuuuucugcuucugcugcaugaucuccgagucccuagggguagagaugauggggcacugggagguaccagagggcaaaaaggac

SEQ ID NO: 5655 - RNA, 118 nt, Bos taurus
auuuugauauauaaaccaguuuaauguuuucugcacagacccuggcuuuucuuaaauuuuauauauuggaaaccccguguuuguauuggaccuucugguuuguuucauauugaaaauc

SEQ ID NO: 5656 - RNA, 91 nt, Bos taurus
gcucugcuuucccaggugcuggaucagugguuugagucugagccucuaaaagccacucuagcaacggacgcagugauuggagcuaugacaa

SEQ ID NO: 5657 - RNA, 74 nt, Bos taurus
uggcccugacugaagaccugcaguuacacuauagcugcugguuucaaacagaggcccagagcacugucuuccug

SEQ ID NO: 5658 - RNA, 91 nt, Bos taurus
ccuaccuaacuggguuagggcccuggcuccaucuccuuuaggaaaaccuucuguggggaguggggcuuugacccuaaccuagcugggcugu

SEQ ID NO: 5659 - RNA, 108 nt, Bos taurus
agaugagaaguuaagaguucauucggcuguccagauguauccaaguacccugauauuuggcaauaaauacaucugggcaacugauugaacuuuuugcuuuucggacuc

SEQ ID NO: 5660 - RNA, 80 nt, Bos taurus
ggguuguggggggucacucuaggccccgcagcacugugcuggauguugcagcugccuaggagugauuucacacaguccuc

SEQ ID NO: 5661 - RNA, 58 nt, Bos taurus; identical to SEQ ID NO: 3053

SEQ ID NO: 5662 - RNA, 149 nt, Bos taurus
caucaagagucggcugagucacugccacugccuaccaaucucgaccggaccucgaccggcucgucuauauugccaaucgacucggcguggcgucggucgugguagauaggcggucauacagacgaguuuucaaguguugcucuggugac

SEQ ID NO: 5663 - RNA, 78 nt, Bos taurus
ggcuucggugcuggggagcggcccccgggcgggccucugcucuggccccuccuggggcccgcacucucgcuccgggcc

SEQ ID NO: 5664 - RNA, 92 nt, Bos taurus
ccugggcggugccuucaggacuguccaaccugagaauggugagcauccagggacaaucucagguuugucagcccgcaaggugccguccccuc

SEQ ID NO: 5665 - RNA, 73 nt, Bos taurus
caccuuguacaugaugacuaaaauuucuucacuuugaccugauggcuauugaagaaaucuaaggucugaggug

SEQ ID NO: 5666 - RNA, 97 nt, Bos taurus
guugaagaggugggugguuucuccguuugccuguuuugcugauguucauuugacuuauucucagcaaaauaagcaaauggaaaauucauccaucaac

SEQ ID NO: 5667 - RNA, 73 nt, Bos taurus
ggcugagccguuggggcugggcugggggcagggaaucuugucugcucucuccgcagaccucagccgcucaacu

SEQ ID NO: 5668 - RNA, 71 nt, Bos taurus
gguuggggaaaccucacucauaaccagcaucccauguuuuuacagugguuuguuuuguguuuuuccucacc

SEQ ID NO: 5669 - RNA, 66 nt, Bos taurus
ccuguccucacaucuuuuugugauuauaucugggucauaacacagaugaugugauucugagauggg

SEQ ID NO: 5670 - RNA, 76 nt, Bos taurus
gcaugggguuccgagugggggcgguggggggcgggucugagccggccucugggcccagccagggucgcuccggggu

SEQ ID NO: 5671 - RNA, 80 nt, Bos taurus
cuggcucucucuguugccauggcaccggccggagaugaggcucuggggggcgguggggggcgggguugcagggaggacag

SEQ ID NO: 5672 - RNA, 72 nt, Bos taurus
aagcaaagguuuuuugguuuuguuuucuguaacaaguuugcagagaacgauacuaaagcaggcaccuagcuu

SEQ ID NO: 5673 - RNA, 78 nt, Bos taurus
uaggagaaggggagauuguuuaguuuuguuuguaguuuacucagcuuuuagagauuucuaagcagucuaauugaccua

SEQ ID NO: 5674 - RNA, 75 nt, Bos taurus
aggcucuugcguuuuguuuggguuuguuuucaacaggcuuguaaagguuguugaugugccaaaccugaacagccu

SEQ ID NO: 5675 - RNA, 63 nt, Bos taurus
ugcacccugagagcuggggcuggucuccuaugggccuugggucucuaaaucuguggcugccgg

SEQ ID NO: 5676 - RNA, 72 nt, Bos taurus
aaugaaaagguagauagaacaggucuuguuugcaaaaugaauucaugaccuacauaucuaccaacagcaaug

SEQ ID NO: 5677 - RNA, 69 nt, Bos taurus
guaagcuucguggucucugucuugcccggacagccuucggagggcaagucagcaggucaggaagcuagc

SEQ ID NO: 5678 - RNA, 60 nt, Bos taurus
cuggaggacuaagaaggcugagucugaugaagcaagacucugcugauacaauccuccuag

SEQ ID NO: 5679 - RNA, 74 nt, Bos taurus
gguuagccuaaaaguucguugggguuuuucuuuaugaucuuauggaagaacccuaacaaaauuuuuggcccacc

SEQ ID NO: 5680 - RNA, 88 nt, Bos taurus
gguuucuggcaaaaaaguuuguuuggguuuuccauguuaaccaaaaacccaaaugaacuuuucagccaacucaauaauuuggggacuu

SEQ ID NO: 5681 - RNA, 79 nt, Bos taurus
ggguuggccaaaaaaaguuuguuuggguuuuccuguaagcugguauggaaaaccugaaacaaacuuuuuagccaaccca

SEQ ID NO: 5682 - RNA, 80 nt, Bos taurus
uuggguugacaaaaaaguuuguuuggguuuucuguaagauaugauggaaaaauccgaacgaacuuuuuggucagcccaau

SEQ ID NO: 5683 - RNA, 81 nt, Bos taurus
uuggguuggcaaaaaaguuuguuuggguuuucucauaacaucuuacagaaaaaccuuaauuaaauuuuuggccaacucagu

SEQ ID NO: 5684 - RNA, 60 nt, Bos taurus
uaaaaguuugguuggguuuuucuguaacaucugauggaaaaaucugaacaaacuuuccgg

SEQ ID NO: 5685 - RNA, 57 nt, Bos taurus
aaauguucgcuuggcuuuuuccauacuaccuuacagaaaaaccugagugaacuuuuc

SEQ ID NO: 5686 - RNA, 71 nt, Bos taurus
uuggcugaaaaguucguuugguuuuuuccacaagauguuagagaaagaaccugauugaacuuuuuggccaa

SEQ ID NO: 5687 - RNA, 80 nt, Bos taurus
auuagguugaccaaaaaguucguuuugguuuuucugcacaaucuuauaaaaacccaaacgaccuuucugaccaauccgau

SEQ ID NO: 5688 - RNA, 78 nt, Bos taurus
ugaguugaccaaaaaguucguuaggguuuuucuucaagcucuuacgggaaaacucgaacaaaccuuuuguccaaccca

SEQ ID NO: 5689 - RNA, 64 nt, Bos taurus
gccaacaaguucguucggauuuuuccauaugagguuaugcgaaaaccugaacaaacauuuuggc

SEQ ID NO: 5690 - RNA, 62 nt, Bos taurus
gccaaaaaguucguucggauuuuuccggaagcuguguggaaaacccgaacaaacuuuuuggc

SEQ ID NO: 5691 - RNA, 71 nt, Bos taurus
uggauugguccaaaaguucguucggcuuuuucuguaacauggaaaaaaauccgcacuuuuaggccaaccca

SEQ ID NO: 5692 - RNA, 67 nt, Bos taurus
guuggcccaaaaguucguucggguuuccuguaugugacggaaaaaccccaaugagcuuuugaccaac

SEQ ID NO: 5693 - RNA, 77 nt, Bos taurus
uggcuuggcugagaaguucguucugguguuucuguaguaucguaugaaaacccggaauuaacuuuuuggccaaccca

SEQ ID NO: 5694 - RNA, 75 nt, Bos taurus
guuggugggccgaaaaguucguucagguuuuccaaguuacagaauaacccagacaaacuguuuggccagcccaau

SEQ ID NO: 5695 - RNA, 74 nt, Bos taurus
aguugaccagaaaaguucggucggguuuuucugcaacaucuaaugaaaaaaccaaaagaacuuuuuggccaccu

SEQ ID NO: 5696 - RNA, 73 nt, Bos taurus
uggccaaaaaguugguucggguuuuuuccccccauacgauguuacggaaaaacucaagcaaacuuuuuagcca

SEQ ID NO: 5697 - RNA, 67 nt, Bos taurus
guuggccagaaaaguuuguucggguuuuccagaggguguuacccaucaaaugaacuuuucagccaac

SEQ ID NO: 5698 - RNA, 70 nt, Bos taurus
uuggccaaaaaguuuauucggguuuuuaccauaaccuguuaggaaaaacccagacagaguuuuuggccaa

SEQ ID NO: 5699 - RNA, 61 nt, Bos taurus
ugggaaaguucguucgggguuuuccauagcauauggugaaucagaacgaacuuuuuggcca

SEQ ID NO: 5700 - RNA, 77 nt, Bos taurus
uggguuggcuugaaaguuuguucgggauuuucaauaauagcuuacgaaaaaccagaacaaauuuuuuggccagcuca

SEQ ID NO: 5701 - RNA, 65 nt, Bos taurus
ggccaaaaaguucguucggaauuuuccaucauaagugguggcuaauccgaacaaauuuuugggcc

SEQ ID NO: 5702 - RNA, 63 nt, Bos taurus
uggguuggcccaaaaguucguucggauuuuacaugccaucuuacgaacuuuuggcccaaccca

SEQ ID NO: 5703 - RNA, 68 nt, Bos taurus
uuggcccaaaaguuuguucggauuuuuuagagauguaacauaaagaccugaaugaacuuuugggucaa

SEQ ID NO: 5704 - RNA, 73 nt, Bos taurus
guuggccgaaacauucacucggguuuuuccauagcaucuuaacagaaaaacucgaaugaauguuuuggccaac

SEQ ID NO: 5705 - RNA, 76 nt, Bos taurus
gccaacugcuaggagcccgacacguacgcuaggggcuggcccaaaaguucguucgguuuuucugcccaauguuggc

SEQ ID NO: 5706 - RNA, 60 nt, Bos taurus
ggaagguucuccaaggaagacuguguugcaguggccaaaaaguucguuugggguuucucc

SEQ ID NO: 5707 - RNA, 96 nt, Bos taurus
uuucaauuauuggguuggccaagaguuuguucggguuucuccauaagcuguauagaaaaaccucaaugaacucuuuggccaacccaauauuuugcu

SEQ ID NO: 5708 - RNA, 96 nt, Bos taurus
ggauuuaguauuggguuggcugaaaaguucguucggguuuuuccauaagaacucaaauaaacuuuuuggccaacccaguaauaacacugaugcacc

SEQ ID NO: 5709 - RNA, 124 nt, Bos taurus
aauaaccccuguuaaggccugcagaacuugcuugaucuauuggguuggccaaaaaguucguucggguuuuuccuuagucccaaacuaaguuuuuggccaacccaauacaaucuguugggcuucc

SEQ ID NO: 5710 - RNA, 78 nt, Bos taurus
ggguuagccaaaaaguucguucggguuuuucuguaagaugguacagaaaaauuggaaugaacauuuuggccaacgcca

SEQ ID NO: 5711 - RNA, 76 nt, Bos taurus
ggguuggucaaaaaguucguucggguuuuucaucagaugguauggaaaaucccaaacgaacucuuugggcaaccua

SEQ ID NO: 5712 - RNA, 77 nt, Bos taurus
aggugggcccaaaaguucguucggguuuuuccauaccaucuuacagaaaaacccaaacaaauuuuuuggcccaccua

SEQ ID NO: 5713 - RNA, 89 nt, Bos taurus
guguuggccaaaaaguucguucggguuuuucuguacauuuauuuaaaagcccaaacagaaaaccucaaaugaaauuucuggccaacuca

SEQ ID NO: 5714 - RNA, 74 nt, Bos taurus
ugguuggccaaaaaguucguucggguuuuuccaugcaauauuacagaaacccaaaugaacuucuuggccaaccc

SEQ ID NO: 5715 - RNA, 77 nt, Bos taurus
ggguuagccaaaaaguucguucggguuuuuccguacccgcauauggaaaagcuugaacaaacucuuuggccaaucca

SEQ ID NO: 5716 - RNA, 79 nt, Bos taurus
uaggcuuggcaaaaaaguuuguuuggguuuuucuauaacaucuugcaggaaaaccugaacaaacuuuuggcuaacccag

SEQ ID NO: 5717 - RNA, 77 nt, Bos taurus
uugaguuggcaaaaaaguuuguuuggguuuuucuguaauaucuuaaaaacccagaugaacuuuuuggccaacccagu

SEQ ID NO: 5718 - RNA, 75 nt, Bos taurus
gguuggcaaaaaaaaaguuuguuuggguuuuuccauaacaucuugcagaaaaaauccaaaccuuuucgcccaccc

SEQ ID NO: 5719 - RNA, 80 nt, Bos taurus
cuggguuggcaaaaaaguuuguuuggguuuuucuguaacauccuauguaauaauccaaaugaacuuuuugaccaaaccaa

SEQ ID NO: 5720 - RNA, 80 nt, Bos taurus
uuggguuggcaaaaaaguuuguuuggguuuuuucauaacauuuaauggaaaacccaaacaaacauuuaggccaacccaau

SEQ ID NO: 5721 - RNA, 80 nt, Bos taurus
uggguuguucaaaaaaguuuguuuggguuuuuccguaagauauuacagagaaauccaaacgaacuuuuuggccaacucaa

SEQ ID NO: 5722 - RNA, 77 nt, Bos taurus
uugguuguccaaaaaaguuuguuuggguuuuucaaaccaucuuacagaaaauccaaaugaaugcuuuggccaaccca

SEQ ID NO: 5723 - RNA, 72 nt, Bos taurus
gguuggccaagaaguucauuuagauuuucuguacaauguuauguaaaaacugaaugaaauucuuggucaauc

SEQ ID NO: 5724 - RNA, 62 nt, Bos taurus
caaaaaguucguccagauuuuuccauaagauguuacagaaaaacuggaacgaacuuuugggc

SEQ ID NO: 5725 - RNA, 59 nt, Bos taurus
gaaaguuuguucuggucuuucuauaagaucguuuggaaaaaccugaaugaacuucuugg

SEQ ID NO: 5726 - RNA, 60 nt, Bos taurus
agaaaguuuguuuggguuuuuccguaagauguaacaggaaaaccugaagagacuuuuugg

SEQ ID NO: 5727 - RNA, 58 nt, Bos taurus
aaaaguucguuucaguuuuuccauaacauuuuacagaaaacccaaaugaacuuuuugg

SEQ ID NO: 5728 - RNA, 61 nt, Bos taurus
agaaaguucauuuagguuuuucuauaggaugcuguggaaaaacuugaacggacuuuuuggc

SEQ ID NO: 5729 - RNA, 88 nt, Bos taurus
uauguauuggguuggccaaaaagcuuguucagguuuuuacaugauguuaaggaaaaacucaaacaaacuuuuggaccaauccaacaug

SEQ ID NO: 5730 - RNA, 89 nt, Bos taurus
aguauuggguuggccaaaaagcuuguucagguuuuuccauaagacaguacagaaaaacuugaacaaacuuguuggcuaacccauaugcu

SEQ ID NO: 5731 - RNA, 72 nt, Bos taurus
guuggccgaaaaguucauuccaguuuuucuguacuaccuuaugggaaaaucugagugaacuuuuuggcuaac

SEQ ID NO: 5732 - RNA, 81 nt, Bos taurus
cugggguagccaaaaaguucauuuggguuuuucuguaagauguuacagaaaaaucugagugaacuuuuuggccaacucuau

SEQ ID NO: 5733 - RNA, 65 nt, Bos taurus
gccgaaauguucguugaaguuuuuccauggggugucacggaagaaaccugaacaaacuuuuuggc

SEQ ID NO: 5734 - RNA, 70 nt, Bos taurus
uuggccaaaagguucgucaugauuucuccauaaaaugcaaugaaaaaaccugaacgaaauuuuuggccaa

SEQ ID NO: 5735 - RNA, 64 nt, Bos taurus
gccaaaaaguucguucggauuucucuguaagcugguguggauaaaccugaacgaacuuuuuggc

SEQ ID NO: 5736 - RNA, 73 nt, Bos taurus
gauuggccaaaaaguucguuuggguuuuucuggaacaucuuauggaaaaaccugaacgaacuuuuuggcccac

SEQ ID NO: 5737 - RNA, 70 nt, Bos taurus
uuggccaaaaaguucauuugaguuuuccugcacuaucuuauggaaaaaccugaaugaacuuuuuggguaa

SEQ ID NO: 5738 - RNA, 89 nt, Bos taurus
uacuauuggguuggccagaaaauuuguucagguuuuucuguacaaugcuaugaaaaaccugaaugaacuuuuuggccaauccaauauau

SEQ ID NO: 5739 - RNA, 61 nt, Bos taurus
gccaaaaaguucauucggauuuuccuguaagauauggaaaaaccugaacaagcuuuuuggc

SEQ ID NO: 5740 - RNA, 78 nt, Bos taurus
uugaguggccgaaaaguuuguuuggcuuuuuccauaccaucuuagggaaaaccugaacaagcuuuuuggccaacccag

SEQ ID NO: 5741 - RNA, 95 nt, Bos taurus
ucuuguauugguuuaaccaaaaaguucauucagguuuuucaguaagaugcuguggaaaaaccugaacaagcuuuuuggccaacccaauauaauga

SEQ ID NO: 5742 - RNA, 89 nt, Bos taurus
aguauuggguuggccaaaaaguucauucagguuuuuccguaagauguuaaugggaaaaccgaaacgaacuuuauggccaaccuaauuaa

SEQ ID NO: 5743 - RNA, 78 nt, Bos taurus
cagguuggcugaaaaguucauucagguuuucccauagcagcuuauggaaaaaccggaacgaacuuuuuggccaaccca

SEQ ID NO: 5744 - RNA, 69 nt, Bos taurus
auuggucaaaaauuuguuuggguuuuuccaguugauguugaaaaaccagaacgaacuuuuuggccaacc

SEQ ID NO: 5745 - RNA, 85 nt, Bos taurus
gcauugggcuggccaaaaagcuucuucgggcuuccuauaagaugguacagaaaaaccagaacgaacuuuuuggccaacccaguac

SEQ ID NO: 5746 - RNA, 70 nt, Bos taurus
augggcaaaaaguuugcuuggauuuuucugugagauauuaugggaaaaccggaaugaacuuuuugacuga

SEQ ID NO: 5747 - RNA, 81 nt, Bos taurus
guuggguuagccaaaaaguuaguucagauuuuuccauagcaucucauggaaaaaccggaaugaacuuuuuggccaacccaa

SEQ ID NO: 5748 - RNA, 81 nt, Bos taurus
uuuggguugaccuaaaaguucauuuggguuuuucuauaacaucuugcagaaaaaccggaaugaacuuuuuggccuacccaa

SEQ ID NO: 5749 - RNA, 73 nt, Bos taurus
auuggguuggccaaaaauuuguaggaguuuuucauauuauggaaaaccggaaugaacuuuuugaucaacccaa

SEQ ID NO: 5750 - RNA, 81 nt, Bos taurus
auuggguuggccagaaaguucauucagguuuuucuuuaacagcuugcugaaaaaccggaaugaacuuuuuggucaacccaa

SEQ ID NO: 5751 - RNA, 82 nt, Bos taurus
uuuuggguuggccauaguucauucgaguuuuucaguaacaccuuagagaaaaacccgcaugaacuuuuuggccaacucaaua

SEQ ID NO: 5752 - RNA, 83 nt, Bos taurus
uauugaguuggccaaaauguuuauucagauuuuuccauagcaccuuauagaaaaacgcaaaugaacuuuuuggccaauccaau

SEQ ID NO: 5753 - RNA, 81 nt, Bos taurus
acuggcuaggcccaaaaguucauuuggguuuucaauaguaucuuacaggaaaacgcaaaugaacuuuuuggccaauccaau

SEQ ID NO: 5754 - RNA, 83 nt, Bos taurus
uauuggguuggccaaaagguucauuuggguuuuuccauaagauguucuagaaaaacgcaaaugaacuuuuuggcuaaugcaau

SEQ ID NO: 5755 - RNA, 82 nt, Bos taurus
aauugagauggccaaaaauuucguucagguuuucuugcaugguagugucaaaaacgcaaaugaacuuuuuggccaacccaau

SEQ ID NO: 5756 - RNA, 81 nt, Bos taurus
uauugguuuggccaaaaagugcauugggauuuuugcauaaagcuuacagaaaacgcaaaugaacuuuuuggccaacuugau

SEQ ID NO: 5757 - RNA, 82 nt, Bos taurus
cacuggguuagccaaaaaguucgucccgguguuuccauaagauguaacggaaaaacccgaaugaacuuuuggccaacccagu

SEQ ID NO: 5758 - RNA, 81 nt, Bos taurus
auuggauuggccaaaaaguuugaguuuucaguaccauccuauggugcugaaaaacccgaaugaacuuuuggccaacccacu

SEQ ID NO: 5759 - RNA, 76 nt, Bos taurus
auuggguuggcccaaaaguucaugcauguuuuuccauuacacggaaaaacccgaaugaacuuuugggacaaccugg

SEQ ID NO: 5760 - RNA, 86 nt, Bos taurus
auuggguuggcuaaaaaguucauuugguuuuuucuguaccaucucaucuuguggaaaaacccgaaugaacuuuuggccaacccaac

SEQ ID NO: 5761 - RNA, 81 nt, Bos taurus
uuggauuuggcccaaaaaguucauuugaguuuuuccuaagagcauauggaaaaacccgaaugaacuuuugggccaauccag

SEQ ID NO: 5762 - RNA, 80 nt, Bos taurus
cuggguuggacaaaaaaauugcucagguuuucccaugagauguucuggaaaaacccgaaugaacuuuugggccaagccaa

SEQ ID NO: 5763 - RNA, 80 nt, Bos taurus
ugggcugaccaaaaaguuuguucgaguuuuuccguaacaucccacugaaaaaacccgaaugaacuuuuggccaacccagc

SEQ ID NO: 5764 - RNA, 82 nt, Bos taurus
auaggauuggccaaagaguucauuuggguuuuucuagugagcuguaaacaaaaaacccgaacgaacuuuuggcugacucaau

SEQ ID NO: 5765 - RNA, 82 nt, Bos taurus
auuggguuggccaaaaugucuauuuggauuuuuccuuuacguccuauggaaaaaacccgaacgaacuuuugggccaacccaa

SEQ ID NO: 5766 - RNA, 81 nt, Bos taurus
guuaggugggccaaaaaauuuguuuggguuuuucuguaagaugguauggaaaaacccgaacgaacuuuugggcccaccuaa

SEQ ID NO: 5767 - RNA, 78 nt, Bos taurus
uuggguuggcccaaaaguucauucgagcuuuuccuuaauauccuacggaaacccgaacgaacuuuugggccaacucag

SEQ ID NO: 5768 - RNA, 76 nt, Bos taurus
auuguguuggucaaaagcucauugggguuuuuccgucacauacaggaaacccgaacgaacuuuugggccaacccaa

SEQ ID NO: 5769 - RNA, 81 nt, Bos taurus
acuggguuggccaaauuguucauuuggguuuuuccguaacaucuuauggaaaaacuugagugaacuuuugggucagcccag

SEQ ID NO: 5770 - RNA, 83 nt, Bos taurus
aaauguuguuggccaaaaaguucauucagguuuucuguaagauguuagggaaggaccugaaugaacuuucuggccaacacauu

SEQ ID NO: 5771 - RNA, 82 nt, Bos taurus
aauuguguuggccaaaagcucauuuggguuuuuccguaagauguuaugaagaaaccuggaugaacuuuuuggccaacccaau

SEQ ID NO: 5772 - RNA, 83 nt, Bos taurus
uauuugguuggccaaaaaguucauuuggguuuuucuguaagauguuauggaaagacccaagugaacucuuuggccgacugaau

SEQ ID NO: 5773 - RNA, 83 nt, Bos taurus
uauugggcuggccaaaaaguucguucagguuuuucuguaccagcuuccagaagaaucuggaugaacuuuuuggccaacccaau

SEQ ID NO: 5774 - RNA, 101 nt, Bos taurus
ggaguaugcuggcguuggccaaaauguucauuccaauuuuucuguaccaucuuacagaaaaacccgaacgaacuuuuuggcuaacccaauaguaaauaccc

SEQ ID NO: 5775 - RNA, 81 nt, Bos taurus
auuggguuggccagaaaguucauuuggguuuuucauuaccauggcaugggagaaccggaacgaacuuuuuggccaacccaa

SEQ ID NO: 5776 - RNA, 83 nt, Bos taurus
uauuggguugaccaaaaguucauucagauuuuccugcaagaucuuacagaaaaucuugaauguacuuucuggucaacccaaua

SEQ ID NO: 5777 - RNA, 86 nt, Bos taurus
uauauuggguuggccaaaaaguuuguucaggguuuuucuaagauguuacggaaaaaucugaaugaacuuuuggccaaccuaauaua

SEQ ID NO: 5778 - RNA, 85 nt, Bos taurus
uguugaguuggccaaaaaguucguuuggauuucucuguaauaucuuacggaaaaacccaaacaaacuuuuuugaacaacccaaua

SEQ ID NO: 5779 - RNA, 96 nt, Bos taurus
uaauuuaaaauguguuggccagaaaguucauucagguccuucccuaacaucuuacagaaaaccugaaugaacuuuuuggccaacaacauuuaauug

SEQ ID NO: 5780 - RNA, 74 nt, Bos taurus
acgcccuggaggagugcgacccugcuucgguagcccaugggggaggaagcagggcggaacgauguguacggugu

SEQ ID NO: 5781 - RNA, 74 nt, Bos taurus
aggcucacacgugcugccgcucaggcucagugccagccacucccacugggacugguggcagcacuucugagucu

SEQ ID NO: 5782 - RNA, 77 nt, Bos taurus
ccagggcaauguccacauuugccagcuuucacuaaacauagaagguaguaggugugugguuuaaauagauugucagg

SEQ ID NO: 5783 - RNA, 74 nt, Bos taurus
gccuucgguugucgcgcgagcucgggcucugcgcucggaugccggcucguguucgagcucgcgucccauggggc

SEQ ID NO: 5784 - RNA, 80 nt, Bos taurus
cucgccguuauucggggaagcagggcacuggagagcgcuucagcacugccucugguggucgguuuguggaugggggcggg

SEQ ID NO: 5785 - RNA, 74 nt, Bos taurus
cgccuuuacuccgcuucaggcuuugugccagaaccagaggggcugauagugagcgacuggggcaggcgagggcg

SEQ ID NO: 5786 - RNA, 70 nt, Bos taurus
caucucugauuuccccaagcucagagacagucagccugaauugagucugagauugaggaaggcagagcug

SEQ ID NO: 5787 - RNA, 72 nt, Bos taurus
uguguucaaugauuuuguuguuuuguauuugaauuucuucuaucgcguuggacagcggacagucguuucaca

SEQ ID NO: 5788 - RNA, 63 nt, Bos taurus
ucuagaggcuguagagggcaucugcugcuuccuggcacucggaugcccucugcugcuuagaga

SEQ ID NO: 5789 - RNA, 67 nt, Bos taurus
gcuccuuucucgcccuccccgacccugcagcgucuuuucaggucggggugggaggaagguucucggc

SEQ ID NO: 5790 - RNA, 70 nt, Bos taurus
gguuccuacagugagcccccguucuccuccugucaagguggacaacugagguuccugcugaaacuggacc

SEQ ID NO: 5791 - RNA, 73 nt, Bos taurus
ggugccacacacucuuuuuucuuauuccugaggcauuaucaagacucaaaguauaagaguuaagaguggcauc

SEQ ID NO: 5792 - RNA, 69 nt, Bos taurus
ugguuaauucaacuuacauuggggauaguggagaacauuccaugacugauguuguuguuugcauugcua

SEQ ID NO: 5793 - RNA, 79 nt, Bos taurus
uaacugaacacacuggauucauuucucugaaaguggauuuuguggucuguccggggaauggauccagcgugaucgguug

SEQ ID NO: 5794 - RNA, 78 nt, Bos taurus
caucuuauuccucagcuaguuuugucucccugugugugaucauaagcagggaggcaaaacuagcuaaggaauaagaug

SEQ ID NO: 5795 - RNA, 74 nt, Bos taurus
ucuuauuccuuagcuaguuuugccucccugcuuaugaucacacacagggagacaaaacuagcugaggaauaaga

SEQ ID NO: 5796 - RNA, 61 nt, Bos taurus
gccuuuuggaggacuuaccucucacugacaguacuggugguuuugguuucccucuuugggc

SEQ ID NO: 5797 - RNA, 76 nt, Bos taurus
gggcguggccccgcgggcgcuggacgccgcugccuuuuaggacaaggagcgggugcaggaccccggcguccugccc

SEQ ID NO: 5798 - RNA, 79 nt, Bos taurus
gugggauaugcuuucugaaugaugucgacugaugggugcgccuuugcagagcggguguuggcucagaagagcagucuac

SEQ ID NO: 5799 - RNA, 74 nt, Bos taurus
cagaucauuuaauaacuggauauucuaauuaugcauguguauaggguugugugguugugugugugugauuucug

SEQ ID NO: 5800 - RNA, 66 nt, Bos taurus
gcucggggguggcggggaggggggcggggcacgguucccuggguuuuucugcacaucuguugcagc

SEQ ID NO: 5801 - RNA, 79 nt, Bos taurus
ccucacauuucugagcauccuggaugugugugccuucuagaaagccaggccugcccaucuaggacaccagucuggaagg

SEQ ID NO: 5802 - RNA, 69 nt, Bos taurus
gggccugauggucaagucagcccggggccugcaugccagccugggagugaugaugaacccucugagccc

SEQ ID NO: 5803 - RNA, 69 nt, Bos taurus
cucaguccucugcuaaagcccaccugugcucccgccuggaaaguugggcuugcagcagagaguaaggag

SEQ ID NO: 5804 - RNA, 75 nt, Bos taurus
aggcagcaggugugagggugguggacggcaggggugggcagguccuggccgccacaggccucacccugcuggucu

SEQ ID NO: 5805 - RNA, 64 nt, Bos taurus
gguuuuuuguuuuguuuggguuuguuucuggaugccagggaaaaccuggaccugucucugaacc

SEQ ID NO: 5806 - RNA, 55 nt, Bos taurus
guacugaaacugugcucguggugugugcuguacagcacgugggcuaguuucagac

SEQ ID NO: 5807 - RNA, 73 nt, Bos taurus
uugggcuggccaaacaguuugucuggguuauucuguaacuuggaaaaccugaacgaacuuuucggcccaccaa

SEQ ID NO: 5808 - RNA, 74 nt, Bos taurus
gggcuggagugcagcugaggaccaaggcagggcugcaugcauucacaugccaguuccacgcugcaugccggccu

SEQ ID NO: 5809 - RNA, 61 nt, Bos taurus
cugcccaugaugacugcugaccucggucucugcagggaccagaagcgagguucagagguag

SEQ ID NO: 5810 - RNA, 80 nt, Bos taurus
uucugaaauaccaaagcauacaauuuaaguugcugcuuauugacagcagaauuuuuggauacuggggacuuuaaucagaa

SEQ ID NO: 5811 - RNA, 75 nt, Bos taurus
cgcuaucccacuccggccuggacugcggcgggaggcugcugucgccgcccagcccuugcuggagccuaucuagug

SEQ ID NO: 5812 - RNA, 72 nt, Bos taurus
aguucucugugaugacaauaccugauagagguacugauaccucuaucauaccugauaccugauagagauacu

SEQ ID NO: 5813 - RNA, 79 nt, Bos taurus
ugucaggaaccccguguaugaugaauuaucugacccggccguugccucucauguaacgcuucucauggcucucacugca

SEQ ID NO: 5814 - RNA, 75 nt, Bos taurus
uauguagcuaagugccuaauacagaguaacaucuuaugaucucaugcuacucuguauuaggcacuuagcuacaua

SEQ ID NO: 5815 - RNA, 71 nt, Bos taurus
uguagcuaagugccuaauacagaguagcaugagaucauaagauguuacucuguauuaggcacuuagcuaca

SEQ ID NO: 5816 - RNA, 75 nt, Bos taurus
uguccccauggcacaggguccagcugucggccgugauacccgaugggucgaugauggucccuguguuuuggggcg

SEQ ID NO: 5817 - RNA, 66 nt, Bos taurus
uugucgguugguuuuuguuuguuugcuuccucucacuaggcauuaaaacagagccacgucugagag

SEQ ID NO: 5818 - RNA, 70 nt, Bos taurus
gggaagaaagcgaaguccauccucauccuauagacaacugauaggaugaggauggacuuagcuuucgccc

SEQ ID NO: 5819 - RNA, 76 nt, Bos taurus
gggcggccugaccugaucaugcuuacugagcaguccaugugcuugcucccucaggaagcaggucagcuggccgcuu

SEQ ID NO: 5820 - RNA, 71 nt, Bos taurus
cgcucauugucugucuuccucacagaugccucuaaaagucauuugggguuggggcaguguggcugugugug

SEQ ID NO: 5821 - RNA, 75 nt, Bos taurus
ggguacucucaaaacuuguuuggauagaaaacucuuggggguuuuguuuggguuuuuuucaaggugcagugaccu

SEQ ID NO: 5822 - RNA, 66 nt, Bos taurus
gugaacaaacacugaauauacucaaucaugagagaaguggggaagguuguuugguuuuguguucau

SEQ ID NO: 5823 - RNA, 66 nt, Bos taurus
ggggaagauggauggcggcuuagccuugggaggguuugcuuuccuugguuguuuuuuuucuuuuuc

SEQ ID NO: 5824 - RNA, 74 nt, Bos taurus
ucugugguggcgggauagaggagaugggugacauacaagccaacccccccuuccucuggaaaaaucagaucaga

SEQ ID NO: 5825 - RNA, 70 nt, Bos taurus
ccuccuggugcuggcucugccccccaugucccaugccccaaguagggggcgagacucaagcacuggcagg

SEQ ID NO: 5826 - RNA, 78 nt, Bos taurus
gggcuccucgcccccucccuuggucgccggcuguugguccuuuugucagucugcgucuggggagggggccaggggcuc

SEQ ID NO: 5827 - RNA, 66 nt, Bos taurus
acuuaucagcucacaucacagaucagaucauauccaggaucugaucugugaugugagcugauaagu

SEQ ID NO: 5828 - RNA, 66 nt, Bos taurus
acuuaucagcucacaucacagaucagauccuggauaugaucugaucugugaugugagcugauaagu

SEQ ID NO: 5829 - RNA, 78 nt, Bos taurus
gagugagggaugggcuugggcagugaggacuggggguccagcccaucucccacuccuuaccccuggccgucccuccuu

SEQ ID NO: 5830 - RNA, 71 nt, Bos taurus
ggguggcuuccgugccugcagaugucugugaauuccucaaggcugagacccugcagccaaagaagcuaccc

SEQ ID NO: 5831 - RNA, 69 nt, Bos taurus
cauagcagcuccagcaccacgugacugacugccuggaggcucucgguuuaaggucuuggagacaaagug

SEQ ID NO: 5832 - RNA, 63 nt, Bos taurus
uuagcaaugcagacuccagggcccuuugguugagcuccggggcccgagagucagcauuguuaa

SEQ ID NO: 5833 - RNA, 72 nt, Bos taurus
ggaagcagguggaggacaccgacugugacuccuggggacuccggacagcagccuguguucucaccuagcucc

SEQ ID NO: 5834 - RNA, 69 nt, Bos taurus
guagauaaugaugacuaacugaauugaugacuuugggcaugguuuaguaaucaguuucaugauuucuau

SEQ ID NO: 5835 - RNA, 76 nt, Bos taurus
aaauagaaagcauuucaaagcuaagguuauggguggcaauuuaucccuaaccguaacuuugaagugcuuucuguuu

SEQ ID NO: 5836 - RNA, 80 nt, Bos taurus
uucacggugcucuuggugguuucuuauuccuuuuuucuuuaaaguuauguggaauauuuaacuauuuaaaguuaaguggg

SEQ ID NO: 5837 - RNA, 73 nt, Bos taurus
cagggaggcugaggacaggggcugacguucauuuucuacaagugugcgucugccccugggcacagcaccccug

SEQ ID NO: 5838 - RNA, 72 nt, Bos taurus
aggucugggcuccugcugcccagucugaggucugcacucuuugccucacuggaccuagcagagcucccacuu

SEQ ID NO: 5839 - RNA, 76 nt, Bos taurus
acaacuccaaggauacgaggcaagguaagaucagagugaugagaggacuucccugguggucuugugcagggugugu

SEQ ID NO: 5840 - RNA, 59 nt, Bos taurus
ucaguagguagaaagaaggcugagaccuuuccaguuugagauccuucaagacuuacugg

SEQ ID NO: 5841 - RNA, 74 nt, Bos taurus
ggagcuaggcguggagcuucuguagugguaguguuccacaccucugcggaaguuggcgcuuucgauuuggcuuu

SEQ ID NO: 5842 - RNA, 74 nt, Bos taurus
cugacaagggaaggggagacgguggaacuuauccagaguguguguaguugaggugacacuguccccaccuccag

SEQ ID NO: 5843 - RNA, 61 nt, Bos taurus
gucgauuccugucccucgaggugguucccugggggcacgaugauggcggaucugaguugac

SEQ ID NO: 5844 - RNA, 63 nt, Bos taurus
cuguggacauaggcuacagacuggcugagaauguuacaguuguguguuuucuuauuuccacag

SEQ ID NO: 5845 - RNA, 79 nt, Bos taurus
ggguuugaccggcacugaugugaaggugguuuggccuugauugugccaugccaccuuuacuccugagccaggcguuccc

SEQ ID NO: 5846 - RNA, 59 nt, Bos taurus
cugcagaggaacaaggcugaacccccaacacgaggaugacagcccugugcucuccacag

SEQ ID NO: 5847 - RNA, 79 nt, Bos taurus
cugcuggccgagguucgggugguguggagcggcccuuugcccgggcucaggggucacgccgcccacccucugcccccag

SEQ ID NO: 5848 - RNA, 65 nt, Bos taurus
uggaagcagucugaggcuggaguccagugaggaacaguggcacuucuggucucagacucaaccca

SEQ ID NO: 5849 - RNA, 76 nt, Bos taurus
ggcucucucucagcuccuguuucucuccucagcuuccccaccaagggcagcaggagccggacccucugacguggcc

SEQ ID NO: 5850 - RNA, 76 nt, Bos taurus
uaggccuacuuuuuaauaguuauuguauuguguuuuagaaaagguacagugaaaauuauggaaucagcuggguuua

SEQ ID NO: 5851 - RNA, 76 nt, Bos taurus
ugcuuugugaaacugaaagaacaggauugcugggagauuuucauucuuccuguucuuacuacaguagauaaaagca

SEQ ID NO: 5852 - RNA, 75 nt, Bos taurus
aguacagugagcccucugucugcagaugcggagcccgcgccuccguagccugcaguacagaggacuggcuguacu

SEQ ID NO: 5853 - RNA, 75 nt, Bos taurus
gagcagauaauuaguagguuguguuguuuaguaauuauuauaaagagcuaagcacuucccuucuaaagucuacuu

SEQ ID NO: 5854 - RNA, 80 nt, Bos taurus
gucauucccagauacaauggacaauaugcuguuauaauuguguggcauuguccuugcuguuuggagauaauacugcugac

SEQ ID NO: 5855 - RNA, 73 nt, Bos taurus
ggaagcuuuucucuugugaugagggagucugaggagcccauguuucaggaugccuuuagugggaagcacuucu

SEQ ID NO: 5856 - RNA, 79 nt, Bos taurus
cugcugccuucuuggucuggcacagagcaugugagggaccacacugcagcuccacaccugugccagccugaggcggaag

SEQ ID NO: 5857 - RNA, 64 nt, Bos taurus
uccaugaacccaacucucuagucacauuugcuuggcugugcuaccaaauaguugggaucgugga

SEQ ID NO: 5858 - RNA, 79 nt, Bos taurus
gcaucuagugcaaugauuguguuguuuucuuuuuaaucuuuuaauaaaucuaggggauagcauugguguauuuucuugu

SEQ ID NO: 5859 - RNA, 70 nt, Bos taurus
gggcgagcgccgccagugcgccugcuccgcgccggcagggagcgcgggcaggaggcuggaggcguucccc

SEQ ID NO: 5860 - RNA, 76 nt, Bos taurus
ugguuacaugcaguuguguuguuuuuuuuuguagaaucuguuuuuauuggcugagugaaacaauuuaacuuaacca

SEQ ID NO: 5861 - RNA, 67 nt, Bos taurus
cuuaggucaguguugguaugguuuucaucaggguuuaugccacugugauggagcguucugaccuaag

SEQ ID NO: 5862 - RNA, 74 nt, Bos taurus
ucuaagaaauauuccuugaccaaguugaaauuaaugagaauagguuucaacuuggucaaggaauauuucuuaga

SEQ ID NO: 5863 - RNA, 72 nt, Bos taurus
cuaagaaauauuccuugaccaaguugaaaccuauucucauuaauuucaacuuggucaaggaauauuucuuag

SEQ ID NO: 5864 - RNA, 74 nt, Bos taurus
ucugugcuucucuguggauggaugugggcaguuguggcuccaggcacugcucgcccgaccccagagugggcaga

SEQ ID NO: 5865 - RNA, 79 nt, Bos taurus
gugagaaauuccuaggagagagggaugauuaaaaguguauacucaguuuuugcuguuucuuaucaggagcuauaaucau

SEQ ID NO: 5866 - RNA, 69 nt, Bos taurus
ccccgggguccucuugucugagccccagaaagaggagagagugcugggucacagaagagggucuggggg

SEQ ID NO: 5867 - RNA, 79 nt, Bos taurus
cuguuugguacacccuguaacucagccaucagaguuuuauguagaacuuugaaaggcacuuacaggaagcaucaggcag

SEQ ID NO: 5868 - RNA, 81 nt, Bos taurus
gugggggaggagcagaggguggccugguaucuggucuuaguauuugacagacugucagaccaccucugccccugugcccac

SEQ ID NO: 5869 - RNA, 70 nt, Bos taurus
guggaauagaaaucaucauuuuuuacauguggccauggcuuguagguuguggguuuuuguuucuuuccac

SEQ ID NO: 5870 - RNA, 79 nt, Bos taurus
aauagggauugugggaaaaugaaaguugguuaugacccuccuccccauaagcaacuuuccuuucuccaccuuccuuauu

SEQ ID NO: 5871 - RNA, 72 nt, Bos taurus
uaaccaauuaauuucauagaauauggaugguauuacaccaaaugcuauaguuuugugugguuuuugggguua

SEQ ID NO: 5872 - RNA, 77 nt, Bos taurus
cuaguccggaauccagucuuuucaucagagcuuugucuuuuugagaaugaugaaaggauugggucacucuggucugg

SEQ ID NO: 5873 - RNA, 78 nt, Bos taurus
gcccugcguccaccuuccccggucagggcucggcagggcgggagucgagcccggcacguggaagagccaccgcaccgu

SEQ ID NO: 5874 - RNA, 77 nt, Bos taurus
cgcgaggcgggcggcguucccgggagccgggcgcucgggcgggguuggggcuggggagaggcgggccgcgugaggcg

SEQ ID NO: 5875 - RNA, 74 nt, Bos taurus
ggagagaucugaucauccuccgggucagagggaguguaccaacacccagugauggagaggucugaucauccucc

SEQ ID NO: 5876 - RNA, 68 nt, Bos taurus
ggggcuugggagggucucagaagcaggaacuuuugcuccuuuccucugagaucuugcuaggcgcuccc

SEQ ID NO: 5877 - RNA, 69 nt, Bos taurus
gacuuagaccacacggggagagcagaguccagagcacaugggccacugcacagaccuaggcucugaguc

SEQ ID NO: 5878 - RNA, 78 nt, Bos taurus
ugggaaggaguguucauggucucaggcuccacuuagcagaggcuucuguggguugucugagcaagggucuuccuccca

SEQ ID NO: 5879 - RNA, 78 nt, Bos taurus
cuuggcuucaaaagcaaacuccauggccucagaacuuuaaucuucaaaggcugcuggagaagauauuuugaagacaag

SEQ ID NO: 5880 - RNA, 72 nt, Bos taurus
ccacuuuaaccuuuuaaaguacaaucacccucagauaugggugggugacuguacuuuaaaagguuaaaaugg

SEQ ID NO: 5881 - RNA, 70 nt, Bos taurus
uggcagccuaggacagaggagcccgauggcacacgaggucccacacaggcugcucugugcuuggcuguca

SEQ ID NO: 5882 - RNA, 77 nt, Bos taurus
gcugcacuuguaggggagugccugggaagcuguuccuuuuggccgacuacuuccuggugccucgccccacacccagc

SEQ ID NO: 5883 - RNA, 76 nt, Bos taurus
ggacggugagcuaagguggggucaugggccaaggccaguggcugagcugagugaugacugcugaccuacaccgucu

SEQ ID NO: 5884 - RNA, 73 nt, Bos taurus
uguccucguaaaacuguacuggaaggauggauggcaggaacuuguaccguucagcuuccaauacuuuggaaca

SEQ ID NO: 5885 - RNA, 75 nt, Bos taurus
ucuucagcuccuggggcaaguggaguacguuggcagagauuuacaaaguacucgcccugucucaguagcagaggg

SEQ ID NO: 5886 - RNA, 75 nt, Bos taurus
gcaaguguacuguuugguuuuucguuuucccugugucuucccacccuuaucuccacaggcaaauggccaucuugc

SEQ ID NO: 5887 - RNA, 78 nt, Bos taurus
agcguggagggccuggaaggccuggcuuugcagcguggacuggacccugcagacccggccuuggcaagcccuuccgcu

SEQ ID NO: 5888 - RNA, 79 nt, Bos taurus
cauaaggagucagcucccgucuccucugugcugagucacaaggaucgcagcucgaggaagcuggagaugacuugugaug

SEQ ID NO: 5889 - RNA, 82 nt, Bos taurus
gcgcccgggcggggccgaggggacucgggagucggagcggagaaccagcccccggccgccgcguccccgcgccgcuccccgc

SEQ ID NO: 5890 - RNA, 72 nt, Bos taurus
ugugcuuucuguuguguguuuuuguuuucccuacucguauggagagaaagagcaauuucaggugaaaggaua

SEQ ID NO: 5891 - RNA, 71 nt, Bos taurus
cucccuggugucuccauucccaucuucaucugugagaacaauggauggaugggggugaggggugcaggggg

SEQ ID NO: 5892 - RNA, 54 nt, Bos taurus
ggcagaggggaggagaggagaagagacaucuuagauuuuuuguuuucuuuugcc

SEQ ID NO: 5893 - RNA, 68 nt, Bos taurus
caggcuucuccccucaaucucaggacuaaccauuuuauugugagccugagaggaaaggggaaugccug

SEQ ID NO: 5894 - RNA, 74 nt, Bos taurus
agagugaccuguuggcagcucucucagacccugacgcaggccugagggcugagggagaggcugacacgccaccu

SEQ ID NO: 5895 - RNA, 69 nt, Bos taurus
gauggucaucgagagcccagugacugggaguaacagugcuucucaugcacuggggucuugaugggcauu

SEQ ID NO: 5896 - RNA, 74 nt, Bos taurus
uuuggaugcguucuuaccacuggccuguaggugacaugauccaaguacagagcaguggcaagaacgcauccaaa

SEQ ID NO: 5897 - RNA, 79 nt, Bos taurus
cucggggugagcaucuagggacgcgucggcaacugcaggacccccugguugccuccccgccccucuugcugaccccggg

SEQ ID NO: 5898 - RNA, 78 nt, Bos taurus
guaauccucacacuuucuguagcuguuggaacuauggugcauugugguucuaacaacuacagaaagugugaaaaucac

SEQ ID NO: 5899 - RNA, 74 nt, Bos taurus
gagggcugcccgagcgcauguggcugaguguggucccuuggcgcccagcacaggcagcucggacugaaacccuc

SEQ ID NO: 5900 - RNA, 75 nt, Bos taurus
ucugguggacagagcuugugucuagggcuguguguauuuagcggcagcugugggcucaggcagucugucugcuga

SEQ ID NO: 5901 - RNA, 68 nt, Bos taurus
uggagaaaggcagagaggcaggcagugcgagggacagggagcauaccugccacucugccagcacuccg

SEQ ID NO: 5902 - RNA, 75 nt, Bos taurus
gaguuucuuuugaggccggccgcuucccagccaggcugaaagggcucgggaagcuagcuggccuuguuggcccuu

SEQ ID NO: 5903 - RNA, 65 nt, Bos taurus
auugcacugcaugguaucugcauucagcaguuuguuccugcuggcuguucaaaagacagugcgau

SEQ ID NO: 5904 - RNA, 67 nt, Bos taurus
uguugcacugcaugguaucugcauucagcaguuuguuccugcuggcuguucaaaagacagugcgaua

SEQ ID NO: 5905 - RNA, 70 nt, Bos taurus
gggccagaacaggagguuuggcguguuuguuuuuaguuugagaugugugguuuguuuggccucaaggccu

SEQ ID NO: 5906 - RNA, 73 nt, Bos taurus
gguagaaagggaagaaggaagcuggauuugugaccacuuuggguuucugugauacagcucuuccccuucuucc

SEQ ID NO: 5907 - RNA, 73 nt, Bos taurus
uggcucacccccucucccccgacccucguuaacccuccacgcugggcggaugggaagggcuggaugcuugccg

SEQ ID NO: 5908 - RNA, 61 nt, Bos taurus
gcugggugggcaggcacacgugugucucagcgccaugcacacgugugugagcucagccggc

SEQ ID NO: 5909 - RNA, 64 nt, Bos taurus
agggcagcguccacgugagaccugguccacgacagaaccgguggucucacauggacgcugcccu

SEQ ID NO: 5910 - RNA, 76 nt, Bos taurus
gggcggggugcugagcugaggaggaccugugagagucgagcugucccugugcuucccugugguccaggcugugcuu

SEQ ID NO: 5911 - RNA, 77 nt, Bos taurus
gaggaaauguggagugacugucagaugcagccagcagaauaagugguuuggcugaacugucuuacucccacauccuc

SEQ ID NO: 5912 - RNA, 78 nt, Bos taurus
uaaugagucauucuuggggcuggguggggagagggcaacugcuuucaauuaaaaccacgccagccagagcacuaguug

SEQ ID NO: 5913 - RNA, 79 nt, Bos taurus
uccucccccucuccccuccaguccacugggcuccuggcaggaagcucggacccagggggacugcggugagucagcagga

SEQ ID NO: 5914 - RNA, 74 nt, Bos taurus
guauuuuguguuagugcggaugguguuauauguuaagacauuaaaguuaacaccauaagcagagcacaaaaugc

SEQ ID NO: 5915 - RNA, 67 nt, Bos taurus
gggagucgguccugccggccaggccugcuggacacuccugccggccaggccugcuggaccgacgccc

SEQ ID NO: 5916 - RNA, 82 nt, Bos taurus
uuggaggacugggcauccaucccacagaagccugacgcagcugcugcagugcccacuguggaagaugcccuacaugcugcag

SEQ ID NO: 5917 - RNA, 75 nt, Bos taurus
acaagucuagauggaggcacugaaaauuuaauuuuggcgucaaauuaaauuuuuagugccuccauauagacuugu

SEQ ID NO: 5918 - RNA, 76 nt, Bos taurus
ggcacagaugggaugaguguggcguggucgagaccuggucugcccuugaccgugucugcucccgucccuucugucu

SEQ ID NO: 5919 - RNA, 76 nt, Bos taurus
ccucuaugaucgcaucaacacucgucuguucuuaaauaacauugagaacaggcgggugcuaauacgaucauagagg

SEQ ID NO: 5920 - RNA, 78 nt, Bos taurus
auguauuuuuuacucuaagugagcacacagcuucaaccacaggagguuguguguuuauucuuucuaaugucucugcau

SEQ ID NO: 5921 - RNA, 78 nt, Bos taurus
gguuuggguguuuaauauuuuuuuguuucguguuugccaugaaaggaaaacaaaacauggaggaggucccauacaacc

SEQ ID NO: 5922 - RNA, 68 nt, Bos taurus
uccuugaggggacugaggugcggagacgcacagaucauugauccuccgcuucccacgucuccucagga

SEQ ID NO: 5923 - RNA, 73 nt, Bos taurus
aagagccuggaagccaaucacacuaagaaguggugcuuaguuuugugugguuguuguuuuccugagugcuuuu

SEQ ID NO: 5924 - RNA, 80 nt, Bos taurus
uccagaggacuuagccugugcuguggccacugagagaugaaacacagaucuuugguaaucugauggcugcaaaugcuggg

SEQ ID NO: 5925 - RNA, 81 nt, Bos taurus
aggcauugagggaccagggcacggauccaugaacuaggcuacuuaccacguucguagacccugcccuccucccuccagccu

SEQ ID NO: 5926 - RNA, 74 nt, Bos taurus
gggaggaauguacaaggaaguggcuuggggaaagagggguuuggauccccugacaccgguccacuuccuuuccc

SEQ ID NO: 5927 - RNA, 75 nt, Bos taurus
caauauuaucaggucauuucaaagagggcugaugggaccaaauccaggggcucuuaucacugugaccaaagauug

SEQ ID NO: 5928 - RNA, 65 nt, Bos taurus
gcccaacauggcuggagugcggcggaggugagccgaccgcccccugcagcuccagccuccugagc

SEQ ID NO: 5929 - RNA, 75 nt, Bos taurus
ugacagaagaguucaaaagggaagcaguggcugagaaaauagucuaaaaacuuuucccuuuuuuugcuuuuugca

SEQ ID NO: 5930 - RNA, 73 nt, Bos taurus
cugagacucugggucggcagggguuuccggugugcuugcauucaaccguguccccucccuccuggcccuucag

SEQ ID NO: 5931 - RNA, 68 nt, Bos taurus
uucaggucauauaaguguggaguuggcuagacuacugguaaugacacccccacuugcaugacccugag

SEQ ID NO: 5932 - RNA, 71 nt, Bos taurus
uaugaccucuaagucuagaaccccucugauucaggauucucugagucaggauucuaggcuuagaggucaua

SEQ ID NO: 5933 - RNA, 77 nt, Bos taurus
ccaggaggggugggggcgcugcagacacggaugguucagaagagaacaccguuucugggcauccucagcccuacugg

SEQ ID NO: 5934 - RNA, 74 nt, Bos taurus
caguacugugguuguugggguuuuuuuguaucuaaaaccauguauacaaaaaagucagaacacauaccacacug

SEQ ID NO: 5935 - RNA, 70 nt, Bos taurus
ggaaaacucgaaugaacucuuuggcugacucaguauuauguuuagcaucagagagucaucagcauguucc

SEQ ID NO: 5936 - RNA, 75 nt, Bos taurus
agcagggugcggcgcagcugucgggagggcgcguccccguccccguccccgcccgaccgccucgcccaacccucu

SEQ ID NO: 5937 - RNA, 61 nt, Bos taurus
cagagggagccauuggauggauaagguuguuuguucaguugugguuuuuuguuuuccuuug

SEQ ID NO: 5938 - RNA, 67 nt, Bos taurus
guggggugugugcuggagccugcuugcuuguguccugggcugaggccugguccuguacccacccugc

SEQ ID NO: 5939 - RNA, 78 nt, Bos taurus
gucuugccgucucuggccuggcugaugaucucauaccuugauggugauaucagaagacagguaggcagacggaccgac

SEQ ID NO: 5940 - RNA, 76 nt, Bos taurus
uccagcugugguggggacuguuuggugcgggguggggccagcugugcagugaugagacccuggaaugagcgcuggg

SEQ ID NO: 5941 - RNA, 70 nt, Bos taurus
ccucccgcccucugccccgucccauccucugguuacucccaagggacaggacaggacagugggagggagg

SEQ ID NO: 5942 - RNA, 76 nt, Bos taurus
gcgccaccacagagcaggggcugugggcugcagcaccaugaagagguucccagcacccagugucugcuugucuugc

SEQ ID NO: 5943 - RNA, 73 nt, Bos taurus
gugaggguugagggcaggaccguaugagguguccaaggaaggcuccacucagccggcccuucccuccccucac

SEQ ID NO: 5944 - RNA, 75 nt, Bos taurus
guagaugcugaauugaauugucauaaauacaaggguaugcuuuuguguuguuuuuuguuuugaugagguauucau

SEQ ID NO: 5945 - RNA, 71 nt, Bos taurus
gcuacuaaaauauauuugaaaucgggccuuuugaaagaugaaaagaccaauuucaaguauauuuucauagc

SEQ ID NO: 5946 - RNA, 77 nt, Bos taurus
cggccccggguuucugggaaccgguuuggcugcugugucauuuuguaccagccccuccuuuucccugcugcccgccg

SEQ ID NO: 5947 - RNA, 73 nt, Bos taurus
ugcaccugcggauacaaccaaacacgguuggagaauauuucacaaucugugguugauuggauccgugggugua

SEQ ID NO: 5948 - RNA, 72 nt, Bos taurus
gcccggggccuugcuggcugaagcccacugcagacuuuucuccgugggcaggagacagcagggcccuggcgc

SEQ ID NO: 5949 - RNA, 73 nt, Bos taurus
agaggcgcgugugccuuuucugcacacuugguauagacucgcacacaugggcaguagaggugcaugugccuuu

SEQ ID NO: 5950 - RNA, 73 nt, Bos taurus
agaggcgcgugugccuuuucugcacacuugguauagacucgcacacauggucaguagaggugcaugugccuuu

SEQ ID NO: 5951 - RNA, 72 nt, Bos taurus
agaggcgcaugugccauuucugcacacucgguauagaugcgcgcacacgucaguagaggcgcgugugccuuu

SEQ ID NO: 5952 - RNA, 67 nt, Bos taurus
agagcacucuccacagaaccuucuccaggcgugcucuggccggaugaggugcucuggagaguggacu

SEQ ID NO: 5953 - RNA, 78 nt, Bos taurus
ccaguugcugggugcuguuuguuuuccuuuuuuaacucaagguuucagagcuaggguuuacacugcaaggcagacugg

SEQ ID NO: 5954 - RNA, 79 nt, Bos taurus
gcaucuugcaucuccucagggcaggaagugcgcagaaacuguaacuccgcgcagaccgcgccugaggggcugccggggc

SEQ ID NO: 5955 - RNA, 72 nt, Bos taurus
cccugugacugggggcugccaggcaggaggcguggcuccuggugucuccucuggccgcucuccuccccaggg

SEQ ID NO: 5956 - RNA, 76 nt, Bos taurus
ccggugacucccugcuuccuaguucagaggcugccccucaccaggcucugugcucggggaggcagggagcccucgg

SEQ ID NO: 5957 - RNA, 72 nt, Bos taurus
acguggagcaccgcugccaggggugcauucuugaggugguuggaacgcacuguccugggaaguggcccaggu

SEQ ID NO: 5958 - RNA, 71 nt, Bos taurus
gcacagcgcggcgcuguucugggaacgcgcucucaucacccaacguugccaacugcagagccgcgcugagc

SEQ ID NO: 5959 - RNA, 67 nt, Bos taurus
auacuagcuuauccuuuccaauuaguaaguauuaacagcauuuuaauuggaaagaguaagcuggugu

SEQ ID NO: 5960 - RNA, 70 nt, Bos taurus
ucccagacccucccguccccuguguccugaguucgcuuccccgcggccagaugaugggagcugauuggga

SEQ ID NO: 5961 - RNA, 68 nt, Bos taurus
gggcuuggagcucuugaggccuggcaugugguuaccuuguacccaggcaccagcagcucugcaagccc

SEQ ID NO: 5962 - RNA, 82 nt, Bos taurus
gagucugccaaguggccacucugucucggauccuggcaaguaaguccuugucagacugagagcagugugccugcuugcuuuc

SEQ ID NO: 5963 - RNA, 69 nt, Bos taurus
gucaccucgguccagucagaacuuucuuuguuucuuugaagagaaaggauuggcugaauuguaggugac

SEQ ID NO: 5964 - RNA, 71 nt, Bos taurus
guaggcugcaugugguggaaaugucugcuucucauuccuuuggaagcaggaauacauccacaacaugcuac

SEQ ID NO: 5965 - RNA, 70 nt, Bos taurus
aagaaugacuucugcugcagaccuggaagacauggagaauagucuccagagcugagcagaacugauacuu

SEQ ID NO: 5966 - RNA, 80 nt, Bos taurus
ccugaguuguuuugagccacaguagagccuuggauggugaaaaguuucuggcucuauuauggcuugaagaaggacuuagg

SEQ ID NO: 5967 - RNA, 58 nt, Bos taurus
cugaguccgguggggcaguguguaccaguaggugacgcagccccuccgucugacucag

SEQ ID NO: 5968 - RNA, 79 nt, Bos taurus
cuuguguccaccccaagccuggcugcuaccuuguuucugagucaggagggcagugaggcucagggcuggacugggcagg

SEQ ID NO: 5969 - RNA, 73 nt, Bos taurus
gauuggcauaggaacauggaagauugucagucaucaucuauuucugccaauuuuccauguuccugugccaguc

SEQ ID NO: 5970 - RNA, 67 nt, Bos taurus
gguuacuguagggccugcggcuuccgcccgugcucgcggaccaccgccaccgccuuaccaugaagcc

SEQ ID NO: 5971 - RNA, 74 nt, Bos taurus
gcaguauaugacucacuuucaaaacucaggagucacauuugucuugugugguuuuggaugucugguaguauugu

SEQ ID NO: 5972 - RNA, 70 nt, Bos taurus
gcauggaggaucugucuaaucucagagggcauuuuugagcauuuccucugaugaagacagcccugcuugc

SEQ ID NO: 5973 - RNA, 71 nt, Bos taurus
gguggcccugaauucugagccuguugagucggugccccauaugucucaggguuugggauucaggugccucc

SEQ ID NO: 5974 - RNA, 72 nt, Bos taurus
ggagugucgggguggcccuugcccaauuugguguguaucugagccaaauuggcagagcuuccucuucuuucu

SEQ ID NO: 5975 - RNA, 59 nt, Bos taurus
gucaguuccuccagccuggcccgggagggguccgccuaccgggccagcuggaaggagac

SEQ ID NO: 5976 - RNA, 71 nt, Bos taurus
uguuucucuucagguuugccacuucacagagaguuuguguugcuugaagugugugaaacugcagcggugca

SEQ ID NO: 5977 - RNA, 72 nt, Bos taurus
aggaguagccgucagauugagcaacguggugcugcucggugguggaaugaugauaagucugacggccagccu

SEQ ID NO: 5978 - RNA, 77 nt, Bos taurus
guugggggucgguggugagcaagcagagacuacauagguugccuuguaucccacuucugacaccauguauugucaac

SEQ ID NO: 5979 - RNA, 73 nt, Bos taurus
cagaagggaaagaguuuguauuguuucuuuuguauuuuuaagacacucaaaccaaagucuuuucuguuuucug

SEQ ID NO: 5980 - RNA, 68 nt, Bos taurus
uuggguaaauuguauuguuucuuaugacaacaauagcaguuaucugugaaacauacauuuugcacuaa

SEQ ID NO: 5981 - RNA, 64 nt, Bos taurus
uuacguugucugcuggguuuuguuggcccucgucagcccucagaggccuggcuccggugcguag

SEQ ID NO: 5982 - RNA, 77 nt, Bos taurus
aggugguguguggggagggauaaggaagaaaaucaggaaaugguaguuuucuuugucguuuuaucuaaaugaagcuu

SEQ ID NO: 5983 - RNA, 80 nt, Bos taurus
gagugaaaaguuccgucaaccauccagcuguuugaggugaugcaaacaaacaucugguugguugagagaauuuuuuacuu

SEQ ID NO: 5984 - RNA, 76 nt, Bos taurus
uuaucugaaaauguaugcaggguuauuauaauuaaaaaggugagcuaugaugacuuugauugcauugaucacauga

SEQ ID NO: 5985 - RNA, 62 nt, Bos taurus
ggugccugcaggcuucaugauggguaucuuccaagggccuuucuagaaucugcagguagucc

SEQ ID NO: 5986 - RNA, 79 nt, Bos taurus
ccuggaauucuggagaagcacgguguagggugggccuaaggguuuaaaaugaggggcaaaaucuguguuuuauuugagg

SEQ ID NO: 5987 - RNA, 74 nt, Bos taurus
cccgccauacggugcagugcuccacucuggccgccuggaaaggagcucuaagggcugggccggucggcguccgg

SEQ ID NO: 5988 - RNA, 73 nt, Bos taurus
uguuuuacauguugauccuauucccucuguuuuaguggagaauuguacaagggaauuaagauguucuaagaca

SEQ ID NO: 5989 - RNA, 78 nt, Bos taurus
uguuguguuucaaaugacaggggacaugaguuuuuuaaucuggcaguuuaaacuuuugcccuccuucauuacauaacg

SEQ ID NO: 5990 - RNA, 71 nt, Bos taurus
uguguuugggaguugggggcgggggggcggguggauuccagcugucuuccccucguggacacugugacaua

SEQ ID NO: 5991 - RNA, 58 nt, Bos taurus
cagcccgggccccuccccuggcuccgcccacagcaucaugggacccagcccagggccu

SEQ ID NO: 5992 - RNA, 65 nt, Bos taurus
gaggcggccagaccagcagggcgcaggggaccauguguccuccuucccguguguugagccgcgug

SEQ ID NO: 5993 - RNA, 58 nt, Bos taurus
ucuggggcgccccgcaccggcgggcaggacggcggcagcgccggggcgccgucucgga

SEQ ID NO: 5994 - RNA, 75 nt, Bos taurus
ccggccuacuuggggcuccgagccgcugccgcauacauuagcgccgccggccgcaccgccgucaccuucagcgcu

SEQ ID NO: 5995 - RNA, 57 nt, Bos taurus
cgucgggaccgggguccggugcggagagcccuucgucccgggacacggggcgcggcc

SEQ ID NO: 5996 - RNA, 57 nt, Bos taurus; identical to SEQ ID NO: 5995

SEQ ID NO: 5997 - RNA, 65 nt, Bos taurus
ccucucucccugcagcaucucagggcacugugugacuugggucgggggugggguggggggguugg

SEQ ID NO: 5998 - RNA, 68 nt, Bos taurus
ggagggugccucuaagccucacuuguccugccugucaaauggggugggguggggggguuggccuuucc

SEQ ID NO: 5999 - RNA, 61 nt, Bos taurus
gcguccccggggcucccgccggcggaguucgguuugcaccggggagggggccggggaucgg

SEQ ID NO: 6000 - RNA, 76 nt, Bos taurus
cggcggccgggaaaggugggcugggcuccggggccccuccccgcccggugcugccccggccgcucccggccuugug

SEQ ID NO: 6001 - RNA, 88 nt, Bos taurus
aaaaaucuuugggcuagguuaguucuauuuuaugaucuguuaugaaauggguuaaggaaaaggauccauguggaagaaagaucagaga

SEQ ID NO: 6002 - RNA, 104 nt, Bos taurus
guggcgacggaggcgcgaccccccccccccccccccccccccgccccgguccgacggggcgacccgccaggggcgcucuggggacaguccgccccgccccgccc

SEQ ID NO: 6003 - RNA, 61 nt, Bos taurus
cguggaggagaaugcccggggcgugcugggcggugcgggcugggcuggcagcuccucccuc

SEQ ID NO: 6004 - RNA, 82 nt, Bos taurus
cgcaacgagggcucgggacacagcccugcuuccuggcccacgucacccgucguggccagagcccuggcccugccaucguguc

SEQ ID NO: 6005 - RNA, 86 nt, Bos taurus
cccugaguugcaauucccugcugaucucacauuaauucaucuuugcuagagaaauaucugagugucuguuuugguucaauaaagcc

SEQ ID NO: 6006 - RNA, 57 nt, Bos taurus
acacccggcuggcgucaacucugaacagauucucggcagaugaaguccaucgggaag

SEQ ID NO: 6007 - RNA, 69 nt, Bos taurus
ggugggagggucccaccgagcacccugucggcuggcagccccggcccagguagugggugcucugccaca

SEQ ID NO: 6008 - RNA, 77 nt, Bos taurus
gguuuaaugcucugcugucagcgcuuugaaauucuuacuaaucuuuuuuugguggagaugccggggacguaauaauu

SEQ ID NO: 6009 - RNA, 68 nt, Bos taurus
agggggagaguugcggcucaugaacuggguccagguggaaggcgggccgggguuggaagguuccagcu

SEQ ID NO: 6010 - RNA, 54 nt, Bos taurus
agucaagugagcggccgcaccggcucucccggagggcgggcggcgacuggaaag

SEQ ID NO: 6011 - RNA, 83 nt, Bos taurus
acgcgcuucucggcgcucacucggcggcaccacugccgcaaaugcggcuucguggucugcgccgagugcucccgcgagcgcuu

SEQ ID NO: 6012 - RNA, 65 nt, Bos taurus
ucaccccagucucuagugagagagccauggcggcaggggcguggcugucccuggaggugggacug

SEQ ID NO: 6013 - RNA, 88 nt, Bos taurus
cgccgcuccgcucccgguuccgcgcucuacgccagcccgcugccugccgggcuggugcaggccgcggagccgggcggcccggcaggca

SEQ ID NO: 6014 - RNA, 70 nt, Bos taurus
acggcagcgccgcgggagccucgguuggccucggauagccggucccccgccguccccgccggcgggccgu

SEQ ID NO: 6015 - RNA, 70 nt, Bos taurus; identical to SEQ ID NO: 6014

SEQ ID NO: 6016 - RNA, 70 nt, Bos taurus; identical to SEQ ID NO: 6014

SEQ ID NO: 6017 - RNA, 80 nt, Bos taurus
aagagcugcuaugacugacauggacuucuuccuuucuggucacacagaagucuagaugucagggguacacuuagcaagaa

SEQ ID NO: 6018 - RNA, 71 nt, Bos taurus
cgggcccaaguucugucaugcacugacugcuccagagcccgagucggaguguaucacagaaccugggccgg

SEQ ID NO: 6019 - RNA, 81 nt, Bos taurus; identical to SEQ ID NO: 824

SEQ ID NO: 6020 - RNA, 100 nt, Bos taurus
ccgcccccgucuccaccccgccccccggagccgcugaguggcggcagcggccccaggaccggguuuccucagacaagagggcggguggaggaggaagcgg

SEQ ID NO: 6021 - RNA, 85 nt, Bos taurus
aggccccuccuucccagccacagcuccugcucgccccugccacgucaaaagaggcagaaggggagucggagcagaaaggggaccc

SEQ ID NO: 6022 - RNA, 97 nt, Bos taurus
auacccaaugaaugcgaaaaccucagucagccuuguggauguauguucugcagaccugacaucuagaggacugacugaaauuuucacuuucagcuaa

SEQ ID NO: 6023 - RNA, 97 nt, Bos taurus
cuucgaucuuugucauggugugcgggaucuuuaguuguggugugcaaacucucaguugcagcuugugggauccaguuccaugaccaaggauuggacc

SEQ ID NO: 6024 - RNA, 97 nt, Bos taurus
aaacagccgacguugcggcaugcgggaucuuuaguuguggugugugaauucuuaguugcagcaacuaaagaucccucaggcugcaaugaagaucaga

SEQ ID NO: 6025 - RNA, 86 nt, Bos taurus
uuugguacugaaaaaaguguuguccgugaaugauucgucauaaguaaagcgaauccaccacgaacaacuucucuucaaguaccaca

SEQ ID NO: 6026 - RNA, 83 nt, Bos taurus
cucgaggaaggcaguagguuguauaguuaucuuccgagggggcaacaucacuacccugaaaccacacaaccuacuaccucacc

SEQ ID NO: 6027 - RNA, 81 nt, Bos taurus
cagagggcaacaguucuucaacuggcagcuuuagcugggucaggacauaaagcuugccacugaagaacuacugcggcucag

SEQ ID NO: 6028 - RNA, 78 nt, Bos taurus
cccagaccuuucaguuaucaaucugucacaagugcacagugguaucucgugacaugaugauccccgagaugucugagg

SEQ ID NO: 6029 - RNA, 98 nt, Bos taurus
cacauccaacacgugacguguugggaucaccgcgguaaguuaauaucagauacacuuaccgugggagaggaucccaacacgucacguaucgguaagca

SEQ ID NO: 6030 - RNA, 78 nt, Bos taurus
cccagccuaaccaaugugcagacuacuguacacauucagagcccccugaacagguagucugaacacuggguuggcggg

SEQ ID NO: 6031 - RNA, 73 nt, Bos taurus
cagccuaaccaaugugcagacuacuguacaauuugggaguccugaacagauagucuaaacacuggguagacgg

SEQ ID NO: 6032 - RNA, 86 nt, Bos taurus
gguuggguuuggauuguuguacuuuuuuuuuuguucguugcauuuuuaggaacaaaaaaaaaagcccaacccuucacaccgcuuca

SEQ ID NO: 6033 - RNA, 55 nt, Bos taurus
guugggcuuuuuuuuuuguuccuaaaaaugcaacgaacaaaaaaaaaaguacaac

SEQ ID NO: 6034 - RNA, 80 nt, Bos taurus
cuggacaaaguuaaaaugcuauucugucauugugauaguucauaugggcacugacaggagagcauuuuaauuuugucaag

SEQ ID NO: 6035 - RNA, 98 nt, Bos taurus
gccagguacguggaugcugaaggucagagggaagugcuucugucugcacauguguucuccaguccucugaccuuccugcaucccguucaucucuagga

SEQ ID NO: 6036 - RNA, 77 nt, Bos taurus
uuggugggagcucggagagugcagcugugggugucagggucaggcacacgcacagcaccucacugagcuccuuccaa

SEQ ID NO: 6037 - RNA, 76 nt, Bos taurus
ggccuacaccccacuccugguaccagcugcuugggcccccccuguggcacaugccucugagauggagggauuaaug

SEQ ID NO: 6038 - RNA, 63 nt, Bos taurus
aauugagaagggauaaggagguguguggagaaggcaauggcaccccacuccugguaccaacau

SEQ ID NO: 6039 - RNA, 77 nt, Bos taurus
auuuugagagguaaaaaauugauuugacuaguucuuuaacacaucuagcaaaucauuuuuuacucuccaaaaagaac

SEQ ID NO: 6040 - RNA, 71 nt, Bos taurus
uccuguucccguuuuucacauguguacugauguuugaucauauguuggacaacguggauagcacccgugag

SEQ ID NO: 6041 - RNA, 63 nt, Bos taurus
ccucggagcgcccucgccagacaccccugccggaugauggacacugagggcaggcuggcucca

SEQ ID NO: 6042 - RNA, 62 nt, Bos taurus
gcaguuaccagucaguuguacuuuauccagugcuaacuauaugauguaaacugaacuauugg

SEQ ID NO: 6043 - RNA, 82 nt, Bos taurus
agccugcugccaagcccacguucaaaggcuguuucuucaaaguuaauggugccgccuuugagcugggaagggaagcgggcag

SEQ ID NO: 6044 - RNA, 62 nt, Bos taurus
uuugcaguaacaggugugaacauucuagcagcaguuugaugaucauguaugauacugcaaac

SEQ ID NO: 6045 - RNA, 78 nt, Bos taurus
ccgccgguucucaggguccgugagcuccucggcguacucggagaacauucgccggaacuccggguccuggaaggcgga

SEQ ID NO: 6046 - RNA, 88 nt, Bos taurus
cugagggucucagcauuuauuucgcaguuucuccucuccgugagcgucugccaggcucacggagaggagaaacugcaccuggccccaa

SEQ ID NO: 6047 - RNA, 93 nt, Bos taurus
ucccuagcucuucugccuccugugaaucucucagucuucuuuguccugaguuuuagccguaacuagcagcgggaacagagaaaagucuagcua

SEQ ID NO: 6048 - RNA, 84 nt, Bos taurus
gucccucuccuugaguauugucagagagagcgauucugugcccacccugagucgucucuccgccuguacucagccagcagcgcc

SEQ ID NO: 6049 - RNA, 88 nt, Bos taurus
ugcacgucugcacugugcucacgugugugccugccgaguguugauucagugaucgguggcgccagcucugagcagaguguuggggugu

SEQ ID NO: 6050 - RNA, 74 nt, Bos taurus
auguguguacucggaauuguuuguguaccuguuuucaaauuccaaguacacaaacaauuccaaguacacacaug

SEQ ID NO: 6051 - RNA, 82 nt, Bos taurus
acucugaacuucugggguaacuuugagcaggggaugaauuguauuucauacccugcucuaguguccccaguggggcagagua

SEQ ID NO: 6052 - RNA, 59 nt, Bos taurus
cuggggacacuagagcaggguaugaaauacaauucauccccugcucaaaguuaccccag

SEQ ID NO: 6053 - RNA, 81 nt, Bos taurus
aacaaggacaccaguuaggccacucagaguaacuaucaguaacuaacugguuacucugaguaaccuaacugguauccuugu

SEQ ID NO: 6054 - RNA, 85 nt, Bos taurus
ggccggggagcuggggaaagcaggagugagggucugcaccccaguaagccucguucugcuuuccccacaggcaccccucaugccc

SEQ ID NO: 6055 - RNA, 79 nt, Bos taurus
gugugcagugcccugcccauucaggugcaguucauguacaauugguguccugugccucgaauggguaugguaaggcuca

SEQ ID NO: 6056 - RNA, 79 nt, Bos taurus; identical to SEQ ID NO: 6055

SEQ ID NO: 6057 - RNA, 79 nt, Bos taurus
gugugcagugcccugcccguucaggugcaguucacguacaauugguguccugugccucgaauggguaugguaaggcuca

SEQ ID NO: 6058 - RNA, 95 nt, Bos taurus
uuguccauauugccggucaaccuucaaugacguggaaaagauggcggcucacaugcgcaugguucacguggacgaagagaugggaccuaaaacag

SEQ ID NO: 6059 - RNA, 82 nt, Bos taurus
cuaaagggagagagggaagagggaaggagggauaacguaggaaagagaucucccuccuccuuccacccuggucucccuuccc

SEQ ID NO: 6060 - RNA, 79 nt, Bos taurus
cuguucucuugagagaucagaggcgcagagugcgucaaugucaaugaagccugugccuuuuaccucuuuaagagcgcac

SEQ ID NO: 6061 - RNA, 90 nt, Bos taurus
gaaaccgugcgcucuuaaagagguaaaaggcacaggcuucauugacauugacgcacucugcgccucugaucucucaagagaacagguuuu

SEQ ID NO: 6062 - RNA, 76 nt, Bos taurus
agauggacaccgcggaggaagguaagacggcagcgcccgcgcccugugcuugcggcucccgcggucgggucgggcc

SEQ ID NO: 6063 - RNA, 84 nt, Bos taurus
uaccuacuucuagacuugguguacuuugagagacaguguuguuuuuugcuccuuuuuuauacuugcuaugucuggacguggcaa

SEQ ID NO: 6064 - RNA, 79 nt, Bos taurus
cauccuucuccagccgucuccuguccuguucugugugcugaacagcagugcggacaggaaagacgguuugagagggaaa

SEQ ID NO: 6065 - RNA, 77 nt, Bos taurus
ucacgaacaaguuccugaugcuaccgcaucacgaacaaguuccugaugcggcagagcauuagagaacaaguucugua

SEQ ID NO: 6066 - RNA, 76 nt, Bos taurus
ggccucccagcucggucucugcuucagcuccaggaaagaauuauucuaagagcagucaggacggauuugguacaug

SEQ ID NO: 6067 - RNA, 73 nt, Bos taurus
gcccugggguuagggggagcgguuggaggacugggggcucagccuuccuaccucucuccguaggagccuggug

SEQ ID NO: 6068 - RNA, 81 nt, Bos taurus
auugaccaacuuuaaguauacgaugaacugcagcaugccaggcuucccugcaguucaucguauacuuaaaguuggucaguu

SEQ ID NO: 6069 - RNA, 80 nt, Bos taurus
acugaccaacuuuaaguauacgaugaacugcagggaagccuggcaugcugcaguucaucguauacuuaaaguuggucaau

SEQ ID NO: 6070 - RNA, 67 nt, Bos taurus
gcugcugagaggucuaauaacuaacaaccucuacauaaauguuaguuauuacagaccucucagcagc

SEQ ID NO: 6071 - RNA, 66 nt, Bos taurus
auagccaguuggggaagaaugcccgugucuuaaagugagaagguuuguucuccaaccuggcucuuu

SEQ ID NO: 6072 - RNA, 59 nt, Bos taurus
uaggauuuggaaagauugcuuugaauuuguagaucaacgcaauucuucaaaaucuuagc

SEQ ID NO: 6073 - RNA, 58 nt, Bos taurus
augugaaauuaccaguauuugucugcuuugaccuacaaaaacuggcagcuucauguaa

SEQ ID NO: 6074 - RNA, 63 nt, Bos taurus
cacucugugcagccgcuccagggaggcagcaguuguggugacuggagcggcugcacagagcgu

SEQ ID NO: 6075 - RNA, 61 nt, Bos taurus
cacacucagauaaaguaggcacuuuuugguucuugaaaugcuaccuagucugagugaguga

SEQ ID NO: 6076 - RNA, 63 nt, Bos taurus
cacagcuccaggggacgccguuccuguccuggacuaugugaguggugcucccuggagcugagc

SEQ ID NO: 6077 - RNA, 57 nt, Bos taurus
auggacugucaccugaggagccuaauaggcaacagucccucaggcaacaguccaaaa

SEQ ID NO: 6078 - RNA, 60 nt, Bos taurus
cugcugacuuugaagguggaagcacggugcuaacaucugcuuccucuuccgguuggcaga

SEQ ID NO: 6079 - RNA, 60 nt, Bos taurus
cagggagggcaggggagggaggcugugugcaggccugcccugacugccgccccccgcagg

SEQ ID NO: 6080 - RNA, 80 nt, Ovis aries
ugggaugagguaguagguuguauaguuuuagggucacacccaccgcugggagauaacuauacaaucuacugucuuuccua

SEQ ID NO: 6081 - RNA, 84 nt, Ovis aries
cggggugagguaguagguugugugguuucaggguagugauguugcccccucggaagauaacuauacaaccuacugccuuccuug

SEQ ID NO: 6082 - RNA, 84 nt, Ovis aries; identical to SEQ ID NO: 5

SEQ ID NO: 6083 - RNA, 87 nt, Ovis aries; identical to SEQ ID NO: 6

SEQ ID NO: 6084 - RNA, 83 nt, Ovis aries; identical to SEQ ID NO: 9

SEQ ID NO: 6085 - RNA, 83 nt, Ovis aries; identical to SEQ ID NO: 5291

SEQ ID NO: 6086 - RNA, 84 nt, Ovis aries; identical to SEQ ID NO: 11

SEQ ID NO: 6087 - RNA, 109 nt, Ovis aries; identical to SEQ ID NO: 5300

SEQ ID NO: 6088 - RNA, 99 nt, Ovis aries
caguaacguugucuauauauacccuguagaaccgaauuugugugguauccauguagucacagauucgauucuaggggaauauauggucgaugcaaaaac

SEQ ID NO: 6089 - RNA, 93 nt, Ovis aries
cauacuuguuccgcucuagcagcacguaaauauugggguaguaaaauaaauauuaaacaccaauauuauugugcugcuuuagcgugacaggga

SEQ ID NO: 6090 - RNA, 84 nt, Ovis aries
gucagaauaaugucaaagugcuuacagugcagguagugauuugugcaucuacugcagugaaggcacuuguagcauuauggugac

SEQ ID NO: 6091 - RNA, 87 nt, Ovis aries; identical to SEQ ID NO: 115

SEQ ID NO: 6092 - RNA, 72 nt, Ovis aries; identical to SEQ ID NO: 3096

SEQ ID NO: 6093 - RNA, 85 nt, Ovis aries; identical to SEQ ID NO: 144

SEQ ID NO: 6094 - RNA, 73 nt, Ovis aries; identical to SEQ ID NO: 5316

SEQ ID NO: 6095 - RNA, 60 nt, Ovis aries; identical to SEQ ID NO: 5317

SEQ ID NO: 6096 - RNA, 84 nt, Ovis aries; identical to SEQ ID NO: 5320

SEQ ID NO: 6097 - RNA, 84 nt, Ovis aries
ggcuguggcuggauucaaguaauccaggauaggcuguuuccauccgugaggccuauucuugauuacuuguuucuggaggcagcu

SEQ ID NO: 6098 - RNA, 85 nt, Ovis aries; identical to SEQ ID NO: 5323

SEQ ID NO: 6099 - RNA, 78 nt, Ovis aries
uggccuggggagcagggcuuagcugcuugugagcagguccacaucaagucguguucacaguggcuaaguuccgccccc

SEQ ID NO: 6100 - RNA, 64 nt, Ovis aries; identical to SEQ ID NO: 165

SEQ ID NO: 6101 - RNA, 81 nt, Ovis aries; identical to SEQ ID NO: 167

SEQ ID NO: 6102 - RNA, 67 nt, Ovis aries; identical to SEQ ID NO: 5334

SEQ ID NO: 6103 - RNA, 88 nt, Ovis aries
ccaaguuuccaguucauguaaacauccuacacucagcuguaacacuugagucggcugggagguggauguuuacuucagcugacuugga

SEQ ID NO: 6104 - RNA, 105 nt, Ovis aries; identical to SEQ ID NO: 5336

SEQ ID NO: 6105 - RNA, 70 nt, Ovis aries; identical to SEQ ID NO: 5337

SEQ ID NO: 6106 - RNA, 81 nt, Ovis aries; identical to SEQ ID NO: 290

SEQ ID NO: 6107 - RNA, 72 nt, Ovis aries
cugcccucggcuucucuacagugcugccuugucgcauggggaucaagcagcauuguacagggcuaugaaggc

SEQ ID NO: 6108 - RNA, 81 nt, Ovis aries; identical to SEQ ID NO: 5363

SEQ ID NO: 6109 - RNA, 80 nt, Ovis aries
ccugccggggcuaaagugcugacagugcagauagugguccugugugcuaccgcacuguggguacuugcugcuccagcagg

SEQ ID NO: 6110 - RNA, 81 nt, Ovis aries; identical to SEQ ID NO: 23

SEQ ID NO: 6111 - RNA, 88 nt, Ovis aries; identical to SEQ ID NO: 5371

SEQ ID NO: 6112 - RNA, 114 nt, Ovis aries
gcuuugaucacugucuccagccugcugaagcucagagggcucugauucagaaagaucaucggauccgucugagcuuggcuggucggaagucuccucaucugcuuccuucggguu

SEQ ID NO: 6113 - RNA, 94 nt, Ovis aries
gggaccgaaugcuuugcuaaagcugguaaaauggaaccaaaucaacuguucgauggauuugguccccuucaaccagcuguagcugcgcauugau

SEQ ID NO: 6114 - RNA, 107 nt, Ovis aries
ggugucagcaccguucagggugugugacugguugaccagaggggcaagcacuccguucacccucugggcugccucgucaccaacccucagcaccaaccgcaccugcc

SEQ ID NO: 6115 - RNA, 92 nt, Ovis aries
ucggaugagcccucggaggacuccauuuguuuugaugauggauucuuacgcuccaucaucgucucaaaugagucuucagaggguucuaucau

SEQ ID NO: 6116 - RNA, 101 nt, Ovis aries
gcguccugucucccagccugaggugcagugcugcaucucuggucaguugggagucugagaugaagcacuguagcucgggaagggagaaguuguucuacagc

SEQ ID NO: 6117 - RNA, 68 nt, Ovis aries; identical to SEQ ID NO: 3179

SEQ ID NO: 6118 - RNA, 97 nt, Ovis aries
ucucuccucacggcccugucucccaacccuuguaccagugugugucucggucccugguacagguacggggaggcagggaccuggggaucccagcagc

SEQ ID NO: 6119 - RNA, 77 nt, Ovis aries
ggcccaguuucugugauacucuccgacucgggcucuggagcagucagugcaugacagaacuugggcccggacggacc

SEQ ID NO: 6120 - RNA, 105 nt, Ovis aries
ugcuaaucugcggaacuugaagauagguuauccguguagccuucgcuuuacuugugacgaaucauacacgguucaccuauuuuuuaguaccaaaucccgccuugg

SEQ ID NO: 6121 - RNA, 109 nt, Ovis aries
agagauacuuggugguacuugaagagaggucuuccauggugcauucgcuuuauucuuugacgaaucauacaugguugaccuuuuuuuagguaucaaaucuggccuugaa

SEQ ID NO: 6122 - RNA, 110 nt, Ovis aries
ugagcuucgagguugcuucagugaacauucaacgcugucggugaguuuggaauuaaaaaucaaaaccaucgaccguugauuguacccuauggccaaccaccaucuccacc

SEQ ID NO: 6123 - RNA, 109 nt, Ovis aries
ugccagggcaggauccagucuucagaggacuccaaggaacauucaacgcugucggugaguuugggauuugaaaaaaccaccgaccguugacuguaccuuggguuccuua

SEQ ID NO: 6124 - RNA, 91 nt, Ovis aries; identical to SEQ ID NO: 5431

SEQ ID NO: 6125 - RNA, 83 nt, Ovis aries
uggcucccacccccuguaacagcaacuccauguggaaguaccacuaguuccaguggggcugcuguuaucuggggugggggcca

SEQ ID NO: 6126 - RNA, 104 nt, Ovis aries; identical to SEQ ID NO: 5443

SEQ ID NO: 6127 - RNA, 86 nt, Ovis aries; identical to SEQ ID NO: 5447

SEQ ID NO: 6128 - RNA, 59 nt, Ovis aries; identical to SEQ ID NO: 5448

SEQ ID NO: 6129 - RNA, 65 nt, Ovis aries; identical to SEQ ID NO: 5449

SEQ ID NO: 6130 - RNA, 62 nt, Ovis aries; identical to SEQ ID NO: 5465

SEQ ID NO: 6131 - RNA, 110 nt, Ovis aries; identical to SEQ ID NO: 5468

SEQ ID NO: 6132 - RNA, 61 nt, Ovis aries
gaaaugguuuaccgucccacauacauucugaauauguaugugggacgguaaaccacaaaag

SEQ ID NO: 6133 - RNA, 101 nt, Ovis aries
cugcugcuugguacuuggagagaggugguccguggcgcguucgcuuuauuuauggcgcacauuacacggucgaccucuuugcgguaucuaaucccgccuug

SEQ ID NO: 6134 - RNA, 110 nt, Ovis aries
ccagcagugcugccucacgguacuuggagggagguuguccguggugaguuugcauugucuaaugaugcccaauacacggucgaucucuuuucgguaucagauugcaccgg

SEQ ID NO: 6135 - RNA, 110 nt, Ovis aries
gcgugcugcugcacuugaugcuugaggagagguugcccguggccgguucgcauucuucaugucgcacaauacacggucggccucucuucgguaucaaaucccaccuugca

SEQ ID NO: 6136 - RNA, 104 nt, Ovis aries
uguaauuggugguacuugaggagagguuuucuaggucuccguuucuuucaugaggaugaaacacaccugguuaaccuuuuuuccaguaucagaucccaccuugg

SEQ ID NO: 6137 - RNA, 124 nt, Ovis aries
cacugguguucuggucaguguucacccaugguaccugaagagagguuuucuggguuucuguuucuuuaaugaggaugaaacacaccugguuaaccucuuuuccaguaucaaaucccaucuugaa

SEQ ID NO: 6138 - RNA, 65 nt, Ovis aries
cucgaauccuuggaaccuaggugugagugcuacucuagugcaacacaccuauucaaggauucaaa

SEQ ID NO: 6139 - RNA, 107 nt, Ovis aries
agcaucucuccugguaccugaagggagaucgaccguguuauauucgcuuuauugacuucgaauaauacaugguugaucuuuucucaguaucaaaucucaccuuggag

SEQ ID NO: 6140 - RNA, 106 nt, Ovis aries
gucuggggcacaaggcagagaagccaggucacgucucugcaguuacaccgcucucgagugccugcugggguggaaccuggucugucugucugucuagcaccacagc

SEQ ID NO: 6141 - RNA, 72 nt, Ovis aries; identical to SEQ ID NO: 3266

SEQ ID NO: 6142 - RNA, 95 nt, Ovis aries; identical to SEQ ID NO: 5509

SEQ ID NO: 6143 - RNA, 103 nt, Ovis aries
uccuucuuugguauuuaaaagguagauucuccuucuaugaguacauuauuuacgauuaaucauagaggaaaauccacguuuucaguaucaaaugcugcuugga

SEQ ID NO: 6144 - RNA, 106 nt, Ovis aries
cgucuuucuuugguauuuaaaagguggauauuccuucuauguuuacgugauucauagauaaucauagaggaaaauccauguuuucaguaucaaaugcuacucugga

SEQ ID NO: 6145 - RNA, 105 nt, Ovis aries
auccuucuuugguauuuaaaagguggauauuccgucuauguuuauguuauuuaugguuaaacauagaggaaauuccacguuuucaguaucaaaugcugcuuggaa

SEQ ID NO: 6146 - RNA, 110 nt, Ovis aries
gggauccauccuguuugguauuuaaaagguagauuuuccuucuaugguuacggguuuggugauuaaucauagaggaaaauccacauuuucaguaucaaaugcugcuuugg

SEQ ID NO: 6147 - RNA, 106 nt, Ovis aries
gcucaauguuugauauucaaaagguggauauuccuucuauguuuacaggauugacagcuaaacauagaggaaaauccacauuuuaaguaucuaaauuugcuuuuga

SEQ ID NO: 6148 - RNA, 130 nt, Ovis aries
agagguaucuuggugcucaggcccugcugacguuugauccuugagcagagguugccuuuggugaauucgcuuuauuuauguugaaucacacaaaggcaacuuucguuugaguaucaaauccugcuuggga

SEQ ID NO: 6149 - RNA, 125 nt, Ovis aries
cugauucuggggucagcaccacuccacgguuccugcagagaugguagacuauggaacguaggcugugugauuucugaccuauguaacaugguccacuaacucucaguauccaauccguccucgga

SEQ ID NO: 6150 - RNA, 103 nt, Ovis aries
ccuucccacgguaccugaaaagaugguugaccacagaacaugcgcugucucuaugucguauguaaugugguccacgucuucucaauaucaaauucagucgcag

SEQ ID NO: 6151 - RNA, 128 nt, Ovis aries
agcgauggaccugcccaaugcuacuacuguuugguacuuaaagcgagguugcccuuuguauauucgguuuuuugacgcagaauauacaagggcaagcucucugugaguaucaaacccuggacccaguc

SEQ ID NO: 6152 - RNA, 126 nt, Ovis aries
cccugcucugucuugccucugccuuucugugguacuugaagagaaguuguucgugguggauucgcuuuacuuaugacgaaucauucacggacaacacuuuuuucaguaccaaauacuaccucuaag

SEQ ID NO: 6153 - RNA, 101 nt, Ovis aries
ccucuccaugguacgcggggagagguuacccgagcaacuuugcaucuggacgacgaauguugcucggugaaccccuuuucgguaucaaaauccaucagaga

SEQ ID NO: 6154 - RNA, 126 nt, Ovis aries
caccugcggucuguggaguaggcgccacuuuggguacuugaggagagguugucugugaugaguucgcuuuauuaaugacgaauauaacacagauggccuguuuucaguaccacccaccccucgugc

SEQ ID NO: 6155 - RNA, 125 nt, Ovis aries
ccccagccucuguccucggcgucccugugugguacucggagagauaguagaccguauagcguacgcuuuaucugugacguauguaacacgguccacuaacccucaguaucaaauccguccucgag

SEQ ID NO: 6156 - RNA, 101 nt, Ovis aries
cauuucgcuguauguggagagauggucgaccauaaaacguacgugugcuuuaugacguaugucacaugguccacuaauucucagcaucagucagccugagg

SEQ ID NO: 6157 - RNA, 124 nt, Ovis aries
agggaagaacgucaguaccagcaaccacucugggguacaggacggauggucgaccaguuggaaaguaauuguuucuaauguacuucaccugguccacuagcuguccguacccacugcagccugc

SEQ ID NO: 6158 - RNA, 91 nt, Ovis aries
cguccugcgaggugucuugcaggccgucaugcaggccacacugacggaaacguugcaggucgucuugcagggcgucucgcaagacgacaca

SEQ ID NO: 6159 - RNA, 90 nt, Ovis aries; identical to SEQ ID NO: 5539

SEQ ID NO: 6160 - RNA, 114 nt, Ovis aries
acccaguggccggggagaaguacggugagccugucauuguucagagaggcuagauccuccuuguugagaaggaucaugaugggcuccucgguguucuccagguagcggcaccac

SEQ ID NO: 6161 - RNA, 111 nt, Ovis aries
caaguguccacuuaugguacuugaagagaggcuggccgugaugaauucgauucaucaaagcgagucauacacggcucuccucucuuuuagugucaaauucugccucggagg

SEQ ID NO: 6162 - RNA, 103 nt, Ovis aries
guuagccuuugguacuugaagaguggcuaucccugcuguguucgcuguauuuaugacgaaucauacagggacauccaguuuuucaguaucaaauacugcucug

SEQ ID NO: 6163 - RNA, 107 nt, Ovis aries
ugcuaaccuuugguacuuggagagugguuaucccuguccuguucguuuuacucaugucgaaucguacagggucauccacuuuuucaguaucaagagcgcagaccgua

SEQ ID NO: 6164 - RNA, 115 nt, Ovis aries
ggggcucccucuggcccccagggccuuguacaugguaggcuuucauucauucguuugcacauucggugaaggucuacugugugccaggcccugugccaggcagcaaguaaaugga

SEQ ID NO: 6165 - RNA, 97 nt, Ovis aries
aucuucgauacuugaaggagagguuauccguguugucuucucuuuauuuaugaugaaacauacacgggaaaccucuuuuuuaguaucaaaucccacc

SEQ ID NO: 6166 - RNA, 126 nt, Ovis aries
gcacauccgugcccaucagggcugaccgcugguaccugagaagaagucgcccauguucuuuucgcuugauuugugucgaaacaaacauggugcacuucuuuuucggugucaaaucucagcgcgggg

SEQ ID NO: 6167 - RNA, 119 nt, Ovis aries
gacacgucagaagccagcauccgagucggguacucgaauggagguuguccaugguguguucauuuuauuuaugaugaguauuacauggccaaucuccuuucaguacuaaauucuucuug

SEQ ID NO: 6168 - RNA, 110 nt, Ovis aries
cacgucgcuaucucauacuugaggagaaauuauccuugguguguucacuuuauuugggaugaaucauacaaggacaauuucuuuuugaguaucaaauccugccucggcgg

SEQ ID NO: 6169 - RNA, 114 nt, Ovis aries
cugaacuugggccaacgucagggaaaggauucugcugucggucccacuccaaaguucgaaacauggguggugggcacagaauccggccucugcuguggcacacgccgccugcuc

SEQ ID NO: 6170 - RNA, 123 nt, Ovis aries
gcugagcugccgaaugauccugaccuguggugcuuaaggagaaguugcccgugucuuuuucgcuuuauaugugacgaaacauucgcggugcacuucuuuuucaguauccaauucagccucgaa

SEQ ID NO: 6171 - RNA, 101 nt, Ovis aries
ucagauuuucaucaccuagggaucuuguuaaaaggcagauucugauucagggaccaagauucugcauuuuuagcaaguucccaagugaugcuaaugcuucu

SEQ ID NO: 6172 - RNA, 105 nt, Ovis aries
gagcccccaaccuggguuaguggaaagguggugggcugcggagcaugugcuuccuucgcgucauaugucugcugaccaucaccuuuagagcccucucgcugagga

SEQ ID NO: 6173 - RNA, 107 nt, Ovis aries
aacuguucagggauauuugaggagagguuauccguguuauguucgcuuggcucaucaugaauaauacaugguuaaccucucuuugaauaucaaacucugccucgagg

SEQ ID NO: 6174 - RNA, 95 nt, Ovis aries
cuggaggagggucuccuugaggggucuuggccucugcccaggacucuuucaugaccaguaggccgaggccccucacaggcggcugcuuacucucc

SEQ ID NO: 6175 - RNA, 105 nt, Ovis aries
cgggagucaccgcugcuuaggguaagugcgucucgggugagcaugcaaugaauugcucgcaugucacucggcccacuacccaagguuguuccaccccuuccuuac

SEQ ID NO: 6176 - RNA, 100 nt, Ovis aries
cacgugccuggguacaugaggugguugaccagagagcacacgcuucauuugugccguuugugaccugguccacuaacccucaguaucuaauccccucuug

SEQ ID NO: 6177 - RNA, 106 nt, Ovis aries
agcugcccuuugguacuugaagagaggauacccuuuguauguucacuuaauuaauggcgaauauacagagggagacucuuauuugcguaucaaacucugacuggga

SEQ ID NO: 6178 - RNA, 103 nt, Ovis aries
ccgcucuccaggguagcugaggggaugguagaccggugacgugcacuucauuuaugauguaggucacccguuugacuauccaccagcacccaguccaucugug

SEQ ID NO: 6179 - RNA, 129 nt, Ovis aries
gaggcgaggucggcaucccuuccugguauuugaagacgcgguugaccaugguguguacgcuuuauuuaugacguaggacacauggucuacuucuucucgauaucacaucuucgccuuggaagaccuucc

SEQ ID NO: 6180 - RNA, 106 nt, Ovis aries
augguuugaaaguaugggauacauuugauggcugauccucucacuacuuuauaccuuggguagugggauuuuaguccaucauagagcaagcagauuuguuuucacc

SEQ ID NO: 6181 - RNA, 129 nt, Ovis aries
ugggagccaucgcccugggccagguacguggaugcugaaggucagagggaagugcuucugucuccacguguguucuccaggccucugaccuuccugcaucccguucaucucuaggaugauggcuagaag

SEQ ID NO: 6182 - RNA, 105 nt, Ovis aries
ccagaggcaguguuggugggagcucggagaguggagcugugggugucagggucaggcacacgcacagcaccucacugagcuccuuccaaaggcaacgucuuccaa

SEQ ID NO: 6183 - RNA, 104 nt, Ovis aries
cuggucugagauguucgaaaggagguuguccgugauguauuugcuuuauuuguggcagauauugcacgguugaucucuuuucuucaucaaaugccuucuugaag

SEQ ID NO: 6184 - RNA, 101 nt, Ovis aries
augguccgugauaggggaguggaugguugaucagagaacauacauuuugucaaugauguaugucaacugauccacagucccucccuauccagucacuucuc

SEQ ID NO: 6185 - RNA, 80 nt, Sus scrofa
cccagguugagguaguagguuguauaguuuagaauuguaucaagggagauaacuguacagccuccuagcuuuccuugggu

SEQ ID NO: 6186 - RNA, 92 nt, Sus scrofa
cacugugggaugagguaguagguuguauaguuuuagggucacacccaccacugggagauaacuauacaaucuacugucuuuccuaacgugau

SEQ ID NO: 6187 - RNA, 94 nt, Sus scrofa
ugugugcauccggguugagguaguagguuguaugguuuagaguuacaccgugggaguuaacuguacaaccuucuagcuuuccuuggagcacacu

SEQ ID NO: 6188 - RNA, 96 nt, Sus scrofa
guuccuaggaagagguaguagguugcauaguuuuagggcagagauuuugcccacaaggagguaacuauacgaccugcugccuuucuuagggccuua

SEQ ID NO: 6189 - RNA, 80 nt, Sus scrofa
gccccgggcugagguaggagguuguauaguugaggaggacacccacggagaucacuauacggccuccuagcuuuccccag

SEQ ID NO: 6190 - RNA, 83 nt, Sus scrofa; identical to SEQ ID NO: 9

SEQ ID NO: 6191 - RNA, 97 nt, Sus scrofa
ucuaucagagugagguaguagauuguauaguugugggguagugauuuuacccuguucaggagauaacuauacaaucuauugccuucccugaggagua

SEQ ID NO: 6192 - RNA, 80 nt, Sus scrofa
ggcugagguaguaguuuguacaguuugagggucuaugauaccacccgguacaggagauaacuguacaggccacugccuug

SEQ ID NO: 6193 - RNA, 85 nt, Sus scrofa; identical to SEQ ID NO: 3419

SEQ ID NO: 6194 - RNA, 108 nt, Sus scrofa
ccgguugacguaccugcuugggggacauacuucuuuaugugcccauauggaccugcuaagcuauggaauguaaagaaguauguauuucaggcugggaacucucaccgg

SEQ ID NO: 6195 - RNA, 84 nt, Sus scrofa
cagccccaucuggaagacuagugauuuuguuguugucucacugcgcucaacaacaagucccagucugccgcauggugccggcca

SEQ ID NO: 6196 - RNA, 109 nt, Sus scrofa
uggauguuggucuaguucuguguggaagacuagugauuuuguuguuuuuagauaacuaaaucgacaacaaaucacagucugccauauggcacaggccaugccucuacag

SEQ ID NO: 6197 - RNA, 89 nt, Sus scrofa; identical to SEQ ID NO: 280

SEQ ID NO: 6198 - RNA, 87 nt, Sus scrofa; identical to SEQ ID NO: 281

SEQ ID NO: 6199 - RNA, 81 nt, Sus scrofa
cccguuucucucuuugguuaucuagcuguaugagugccacagagccgucauaaagcuagauaaccgaaaguagaaaugacu

SEQ ID NO: 6200 - RNA, 80 nt, Sus scrofa
ucuguauauacccuguagauccgaauuuguguaaggaauuuuguggucacaaauucguaucuaggggaauauguaguuga

SEQ ID NO: 6201 - RNA, 80 nt, Sus scrofa
gucuauauauacccuguagaaccgaauuugugugguauccacauagucacagauucgauucuaggggaauauauggucga

SEQ ID NO: 6202 - RNA, 79 nt, Sus scrofa
uuggaguaaaguagcagcacauaaugguuuguggauuuugaaaaggugcaggccauauugugcugccucaaaaauacaa

SEQ ID NO: 6203 - RNA, 98 nt, Sus scrofa
uugaggccuuaaaguacuguagcagcacaucaugguuuacauacuacaaucaagaugcgaaucauuauuugcugcucuagaaauuuaaggaaauucau

SEQ ID NO: 6204 - RNA, 77 nt, Sus scrofa
uccgcucuagcagcacguaaauauuggcguaguaaaauaaauauuaaacaccaauauuauugugcugcuuuagcgug

SEQ ID NO: 6205 - RNA, 79 nt, Sus scrofa
cagugccuuagcagcacguaaauauuggcguuaagauucuaaaauuaucuccaguauuaacugugcugcugaaguaagg

SEQ ID NO: 6206 - RNA, 77 nt, Sus scrofa
gaauaaugucaaagugcuuacagugcagguagugauaaugugcaucuacugcagugaaggcacuuguagcauuaugg

SEQ ID NO: 6207 - RNA, 92 nt, Sus scrofa; identical to SEQ ID NO: 2767

SEQ ID NO: 6208 - RNA, 83 nt, Sus scrofa
ucucuuguguuaaggugcaucuagugcaguuagugaagcagcuuagaaucuacugcccuaaaugccccuucuggcacaggcug

SEQ ID NO: 6209 - RNA, 82 nt, Sus scrofa; identical to SEQ ID NO: 114

SEQ ID NO: 6210 - RNA, 80 nt, Sus scrofa
cuguucuaugguuaguuuugcagguuugcauccagcugugugauauucugcugugcaaauccaugcaaaacugacugugg

SEQ ID NO: 6211 - RNA, 80 nt, Sus scrofa
uacaguuaguuuugcagguuugcauuucagcguauguauguguauauggcugugcaaauccaugcaaaacugauugugau

SEQ ID NO: 6212 - RNA, 71 nt, Sus scrofa; identical to SEQ ID NO: 128

SEQ ID NO: 6213 - RNA, 80 nt, Sus scrofa
ccggcaguaccaaagugcucacagugcagguagguuuugcauuacucuacuguagugugggcacuuccaguacucuugga

SEQ ID NO: 6214 - RNA, 80 nt, Sus scrofa; identical to SEQ ID NO: 6213

SEQ ID NO: 6215 - RNA, 92 nt, Sus scrofa; identical to SEQ ID NO: 4627

SEQ ID NO: 6216 - RNA, 80 nt, Sus scrofa
gagccgcaguaguucuucaguggcaagcuuuauguccugacccagcuaaagcugccaguugaagaacuguugcccucugc

SEQ ID NO: 6217 - RNA, 70 nt, Sus scrofa
cggcugggguuccuggggaugggauuugcugccugucacaaaucacauugccagggauuuccaaucgacc

SEQ ID NO: 6218 - RNA, 80 nt, Sus scrofa
cucuggcugcuuggguuccuggcaugcugauuugugacuuaagauuaaaaucacauugccagggauuaccacgcagccac

SEQ ID NO: 6219 - RNA, 72 nt, Sus scrofa
cucugccucccgugccuacugagcugaaacacaguugauuugugcagacuggcucaguucagcaggaacagg

SEQ ID NO: 6220 - RNA, 80 nt, Sus scrofa
gacccgcccuccggugccuacugagcugauaucaguucucauuuuacacacuggcucaguucagcaggaacaggagucga

SEQ ID NO: 6221 - RNA, 84 nt, Sus scrofa; identical to SEQ ID NO: 156

SEQ ID NO: 6222 - RNA, 82 nt, Sus scrofa
uggccuggggagcagggcuuagcugcuugugagcagguccacagcaagucguguucacaguggcuaaguuccgcccccugga

SEQ ID NO: 6223 - RNA, 80 nt, Sus scrofa
acgaggugcagagcuuagcugauuggugaacagugacugguuuccgcuuuguucacaguggcuaaguucugcaccugaag

SEQ ID NO: 6224 - RNA, 86 nt, Sus scrofa
gguccuugcccucaaggagcucacagucuauugaguugccuuucugucuuccccacuagauugugagcuccuggagggcaggcacu

SEQ ID NO: 6225 - RNA, 86 nt, Sus scrofa
ccccuuagaggaugacugauuucuuuugguguucagagucaauauaauuuucuagcaccaucugaaaucgguuauaaugauugggg

SEQ ID NO: 6226 - RNA, 81 nt, Sus scrofa
cuucaggaagcugguuucauauggugguuuagauuuaaaaagugauugucuagcaccauuugaaaucaguguucuuggggg

SEQ ID NO: 6227 - RNA, 84 nt, Sus scrofa
cuucuggaagcugguuucacaugguggcuuagauuuuuccaucuuuguaucuagcaccauuugaaaucaguguuuuaggaguaa

SEQ ID NO: 6228 - RNA, 88 nt, Sus scrofa; identical to SEQ ID NO: 168

SEQ ID NO: 6229 - RNA, 107 nt, Sus scrofa
ucccugcgacagugagcggcuguaaacauccucgacuggaagcugugaggcugaagacgggcuuucagucggauguuugcagccgccgacugccucccgcaucagga

SEQ ID NO: 6230 - RNA, 76 nt, Sus scrofa
uuucaguucguguaaacauccuacacucagcuguaauacauggauuggcugggagguggauguuuacuucagcuga

SEQ ID NO: 6231 - RNA, 80 nt, Sus scrofa
cguagugcguguaaacauccuacacucucagcugugagcucgagguggcugggagaggguuguuuacuccuucugccaug

SEQ ID NO: 6232 - RNA, 80 nt, Sus scrofa
gacagauacuguaaacauccuacacucucagcuguggaaaguaagaaagcugggagaaggcuguuuacucucucugccuu

SEQ ID NO: 6233 - RNA, 79 nt, Sus scrofa
cuguuguuguaaacauccccgacuggaagcuguaagacauagcuaagcuuucagucagauguuugcugccaccgacucu

SEQ ID NO: 6234 - RNA, 80 nt, Sus scrofa
uuugccacuguaaacauccuugacuggaagcugugaggcguucccaggagcuuucagucggauguuuacagcggcaggcu

SEQ ID NO: 6235 - RNA, 78 nt, Sus scrofa
acuggagaggaggcaagaugcuggcauagcuguuaaacugagaaccugcuaugccaacauauugccaucuuucuuguc

SEQ ID NO: 6236 - RNA, 70 nt, Sus scrofa
ggagauauugcacauuacuaaguugcauguugucacggccucagugcaauuuagugugugugauauuuuc

SEQ ID NO: 6237 - RNA, 76 nt, Sus scrofa
uuucuuuggcagugucuuagcugguuguugugaguaauagcaaaggaagcaaucagcagcauccugcccuagaaca

SEQ ID NO: 6238 - RNA, 80 nt, Sus scrofa
agucuaguuacuaggcaguguaguuagcugauugcugauaaaaccaaucacuaaccacacggccagguaaaaagauuugg

SEQ ID NO: 6239 - RNA, 74 nt, Sus scrofa
ucuaguuacuaggcaguguaguuagcugauugcugauaaaaccaaucacuaaccacacggccagguaaaaagau

SEQ ID NO: 6240 - RNA, 80 nt, Sus scrofa
cuuucuacacagguugggaucgguugcaaugcuguguuucuguaugguauugcacuugucccggccuguugaguuuggug

SEQ ID NO: 6241 - RNA, 80 nt, Sus scrofa
cuuucauccguggguggggauuuguugcauuacuugugguguguauaaaguauugcacuugucccggccuguggaagaaa

SEQ ID NO: 6242 - RNA, 80 nt, Sus scrofa
gcgggcgggagggacgggacgcggugcaguguuguucuuuccccugccaauauugcacucgucccggccuccggcccccc

SEQ ID NO: 6243 - RNA, 81 nt, Sus scrofa
aacacagugggcgcucaauaaauguuuguugaauugagaugcguuaaauucaacggguauuuauugagcacccacucugug

SEQ ID NO: 6244 - RNA, 80 nt, Sus scrofa
gggugagguaguaaguuguauuguugugggguagggauuuuaggccccaauuagaagauaacuauacaacuuacuacuuu

SEQ ID NO: 6245 - RNA, 80 nt, Sus scrofa
ccauuggcauaaacccguagauccgaucuuguggugaaguggaccgcacaagcucgcuucuaugggucugugucagugug

SEQ ID NO: 6246 - RNA, 70 nt, Sus scrofa; identical to SEQ ID NO: 291

SEQ ID NO: 6247 - RNA, 80 nt, Sus scrofa
aggccuguugccacaaacccguagauccgaacuugugcugauagugcacacaagcuugugucuauagguaugugucugug

SEQ ID NO: 6248 - RNA, 91 nt, Sus scrofa
gacugaacuguccuuuuucgguuaucaugguaccgaugcuguauaucugaaagguacaguacugugauaacugaagaaugguggugccauc

SEQ ID NO: 6249 - RNA, 81 nt, Sus scrofa
ggcugcccuggcucaguuaucacagugcugaugcuguccauucuaaagguacaguacugugauaacugaaggauggcagcc

SEQ ID NO: 6250 - RNA, 82 nt, Sus scrofa
cuuacugcccucggcuucuuuacagugcugccuuguugcauauggaucaagcagcauuguacagggcuaugaaggcacugag

SEQ ID NO: 6251 - RNA, 80 nt, Sus scrofa
ugugcuuucagcuucuuuacagugcugccuuguagcauucaggucaagcagcauuguacagggcuaugaaagaacuaaga

SEQ ID NO: 6252 - RNA, 81 nt, Sus scrofa; identical to SEQ ID NO: 2819

SEQ ID NO: 6253 - RNA, 80 nt, Sus scrofa
ugugcaucguggucaaaugcucagacuccuugguggcugcuuaugcaccacggauguuugagcaugugcuauggugucua

SEQ ID NO: 6254 - RNA, 81 nt, Sus scrofa
ccuuggccguguaaaagugcuuacagugcagguagcuuuuugagaucuacugcaaugcaagcacuucuuacauuaccaugg

SEQ ID NO: 6255 - RNA, 87 nt, Sus scrofa
uucucucugcuuucagcuucuuuacaguguugccuuguggcauggaguucaagcagcauuguacagggcuaucaaagcacagagagc

SEQ ID NO: 6256 - RNA, 85 nt, Sus scrofa; identical to SEQ ID NO: 5366

SEQ ID NO: 6257 - RNA, 105 nt, Sus scrofa
ucaagaccagacucugcccuccguguucacagcggaccuugauuuaaugucauacaauuaaggcacgcggugaaugccaagagcggagccuacggcugcacuuga

SEQ ID NO: 6258 - RNA, 85 nt, Sus scrofa; identical to SEQ ID NO: 29

SEQ ID NO: 6259 - RNA, 80 nt, Sus scrofa
ggccucugagucccugagacccuuuaaccugugaggacauccagggucacaggugagguucuugggagccuggcguccgg

SEQ ID NO: 6260 - RNA, 80 nt, Sus scrofa
ccucucagucccugagacccuaacuugugauguuuaccguuuaaauccacggguuaggcucuugggagcugcgagccgug

SEQ ID NO: 6261 - RNA, 89 nt, Sus scrofa; identical to SEQ ID NO: 34

SEQ ID NO: 6262 - RNA, 73 nt, Sus scrofa
cgacgggacauuauuacuuuugguacgcgcugugacacuucaaacucguaccgugaguaauaaugcgcugucg

SEQ ID NO: 6263 - RNA, 80 nt, Sus scrofa
aucgcugucuccagccugcugaagcucagagggcucugauucagaaagaucaucggauccgucugagcuuggcuggucgg

SEQ ID NO: 6264 - RNA, 82 nt, Sus scrofa; identical to SEQ ID NO: 37

SEQ ID NO: 6265 - RNA, 80 nt, Sus scrofa
gcagugggaaggggggccgaggcacuguccgagagugaguagcaggucucacagugaaccggucucuuucccuacugugu

SEQ ID NO: 6266 - RNA, 80 nt, Sus scrofa
cuucgugaaucuuuuugcggucugggcuugcuguacauaacucaauagccggaagcccuuaccccaaaaagcauucgcgg

SEQ ID NO: 6267 - RNA, 84 nt, Sus scrofa
cccuuuggaucuuuuugcggucugggcuugcuguuccucucuacaguagucaggaagcccuuaccccaaaaaguaucugcggga

SEQ ID NO: 6268 - RNA, 79 nt, Sus scrofa
cgggccggagcucuuuucacauugugcuacugucugcaccuaucacuagcagugcaauguuaaaagggcauuggccacg

SEQ ID NO: 6269 - RNA, 80 nt, Sus scrofa
gccugccugacacucuuucccuguugcacuacugugggccacugggaagcagugcaaugaugaaagggcaucagucaggc

SEQ ID NO: 6270 - RNA, 78 nt, Sus scrofa
cuccagggcaaccguggcuuucgauuguuacugugggaaccggagguaacagucuacagccauggucgccccgcagca

SEQ ID NO: 6271 - RNA, 103 nt, Sus scrofa
cgggacccaaaugcuuugcuaaagcugguaaaauggaaccaaaucaacuguugaauggauuugguccccuucaaccagcuguagcugcgcauugacagcgccg

SEQ ID NO: 6272 - RNA, 73 nt, Sus scrofa
uagagcugguaaaauggaaccaaaucgccucuucaauggauuugguccccuucaaccagcuguagcuaugcau

SEQ ID NO: 6273 - RNA, 80 nt, Sus scrofa
ccugcucuggcuggucaaacggaaccaaguccgucuuccugagagguuugguccccuucaaccagcuauagcagggcugg

SEQ ID NO: 6274 - RNA, 90 nt, Sus scrofa
aggccucgcuguucucuauggcuuuuuauuccuaugugauucuacugcucauucauauagggauuggagccguggcgcacggcggggaca

SEQ ID NO: 6275 - RNA, 100 nt, Sus scrofa; identical to SEQ ID NO: 49

SEQ ID NO: 6276 - RNA, 82 nt, Sus scrofa
ugagcccucggaggacuccauuuguuuugaugauggauucuuacgcuccaucaucgucucaaaugagucuucagaggguucu

SEQ ID NO: 6277 - RNA, 82 nt, Sus scrofa
acucucuucggugacggguauucuuggguggauaauacggauuacguuguuauugcuuaagaauacgcguagucgaggagag

SEQ ID NO: 6278 - RNA, 85 nt, Sus scrofa
gcgguggggcagcugguguugugaaucaggccguugccaaucagagaacggcuacuucacaacaccagggucacaccccaccaca

SEQ ID NO: 6279 - RNA, 68 nt, Sus scrofa; identical to SEQ ID NO: 55

SEQ ID NO: 6280 - RNA, 70 nt, Sus scrofa; identical to SEQ ID NO: 3529

SEQ ID NO: 6281 - RNA, 80 nt, Sus scrofa
gugcagucacccauaaaguagaaagcacuacuaacagcacuggaggguguaguguuuccuacuuuauggaugaguguacu

SEQ ID NO: 6282 - RNA, 80 nt, Sus scrofa
gucccccagccggaggugcagugcugcaucucuggucagcugggagucugagaugaagcacuguagcucgggaagggaga

SEQ ID NO: 6283 - RNA, 76 nt, Sus scrofa
gcccuggcugggauaucaucauauacuguaaguuugcgaugagacacuacaguauagaugauguacuaguccgggu

SEQ ID NO: 6284 - RNA, 86 nt, Sus scrofa
caccuuguccucacgguccaguuuucccaggaaucccuuagaugcugagauggggauuccuggaaauacuguucuugaggucaugg

SEQ ID NO: 6285 - RNA, 78 nt, Sus scrofa
uacucagcuuugagaacugaauuccauggguugugucauugucagaccugugaaguuuaguucuucagcugggauauc

SEQ ID NO: 6286 - RNA, 99 nt, Sus scrofa
gaacuuuggccaccuggcucugagaacugaauuccauaggcugugagcucuagcaaaugcccuaggaacucaguucuggugcccggcugugcuauaguc

SEQ ID NO: 6287 - RNA, 68 nt, Sus scrofa; identical to SEQ ID NO: 3179

SEQ ID NO: 6288 - RNA, 80 nt, Sus scrofa
auuugaggugaaguucuguuauacacucaggcuguggcucucugaaagucagugcaucacagaacuuugucucgaaagcu

SEQ ID NO: 6289 - RNA, 76 nt, Sus scrofa
gcccaggcucuggcuccgugucuucacucccguguguguccgaggagggagggagggacgggggcugugcuggggc

SEQ ID NO: 6290 - RNA, 77 nt, Sus scrofa
cucggcccuaucucccaacccuuguaccagugcgugccucagucccugguacaggaauggggggcagggaccugggg

SEQ ID NO: 6291 - RNA, 77 nt, Sus scrofa; identical to SEQ ID NO: 6290

SEQ ID NO: 6292 - RNA, 80 nt, Sus scrofa
uuuuccugcccucgaggagcucacagucuaguacgucucauccccuacuagacugaagcuccuugaggacagggaucguc

SEQ ID NO: 6293 - RNA, 80 nt, Sus scrofa
cggcccagguucugugauacacuccgacucgggcucuggagcagucagugcaugacagaacuugggcccggacggaccuu

SEQ ID NO: 6294 - RNA, 87 nt, Sus scrofa; identical to SEQ ID NO: 74

SEQ ID NO: 6295 - RNA, 81 nt, Sus scrofa
cuauaugcuguuaaugcuaauugugauagggguuuuuaccuccgucugacuccuacauguuagcauuaacaggguaugaug

SEQ ID NO: 6296 - RNA, 104 nt, Sus scrofa
gaguuuagagguugcuucagugaacauucaacgcugucggugaguuuggaauucaaaucaaaaccaucgaccguugauuguacccuauggccaaccaucagcuc

SEQ ID NO: 6297 - RNA, 80 nt, Sus scrofa
acuccaaggaacauucaacgcugucggugaguuugggauuugaaaaaaccaccgaccguugacuguaccuugggguucuu

SEQ ID NO: 6298 - RNA, 80 nt, Sus scrofa
ggucacaaucaacauucauugcugucgguggguugaacuguguagacaagcucacugaacaaugaaugcaacuguggccc

SEQ ID NO: 6299 - RNA, 86 nt, Sus scrofa
auggcugcacucaacauucauugcugucgguggguuugagucugaaucaacucacugaucaaugaaugcaaacugcggaccaaaca

SEQ ID NO: 6300 - RNA, 87 nt, Sus scrofa
caaggguuugggggaacauucaaccugucggugaguuugggcagcucaggcaaaccaucgaccguugaguggaccccgaggccugga

SEQ ID NO: 6301 - RNA, 80 nt, Sus scrofa
ucacaaucaacauucauuguugucgguggguugugagacggaggccagacccaccgagggaugaaugucacuguggcugg

SEQ ID NO: 6302 - RNA, 84 nt, Sus scrofa
ucgcaccguuuuuggcaaugguagaacucacacuggugagauaaugggauccggugguucuagacuugccaacuauggugcgag

SEQ ID NO: 6303 - RNA, 70 nt, Sus scrofa; identical to SEQ ID NO: 5423

SEQ ID NO: 6304 - RNA, 83 nt, Sus scrofa
ccagucacauccccuuaucacuuuuccagccagcuuugugacucuaaauguuggacggagaacugauaaggguaggugauuga

SEQ ID NO: 6305 - RNA, 76 nt, Sus scrofa
ggugagggauuggagagaaaggcaguuccugaugguccccuccccaggggcuggcuuuccucugguccuucccucc

SEQ ID NO: 6306 - RNA, 82 nt, Sus scrofa
ugcuuauaacuuuccaaagaauucuccuuuugggcuuuaugauuuuauuuuaagcccaaaggugaauuuuuugggaaguuug

SEQ ID NO: 6307 - RNA, 78 nt, Sus scrofa
ugagaccucgggcuacaacacgggacucgggcgcugcucugaccccucgugucuuguguugcagccggagggacgcag

SEQ ID NO: 6308 - RNA, 82 nt, Sus scrofa
ggccucugugugauauguuugauauauuagguuguuauuuaauccaacuauauaucaaacauauuccuacagugucuugccc

SEQ ID NO: 6309 - RNA, 83 nt, Sus scrofa
ugcuucugugugauauguuugauauuggguuguuuaauuaggaaccaacuaaaugucaaacauauucuuacagcaguaggcaa

SEQ ID NO: 6310 - RNA, 80 nt, Sus scrofa
acagcgggcaacggaaucccaaaagcagcuguugucuccagagcauuccagcugcacuuggauuucguucccugcucucu

SEQ ID NO: 6311 - RNA, 80 nt, Sus scrofa
gcacagggcucugaccuaugaauugacagccagugcucucaucuccccucuggcugccaauuccauaggucacagguaug

SEQ ID NO: 6312 - RNA, 80 nt, Sus scrofa
gcgggagcugagggcugggucuuugcgggcgagaugaggguguugguucaacuggccuacaaagucccaguccucggccc

SEQ ID NO: 6313 - RNA, 76 nt, Sus scrofa
ugccacccccuguaacagcaacuccauguggaagugcccacuaguuccaguggggcugcuguuaucuggggugggg

SEQ ID NO: 6314 - RNA, 78 nt, Sus scrofa
cgccaucagcuguaacagcgacuccauguggacugugccccaauuuccaguggagaugcuguuaccuuugacggcgac

SEQ ID NO: 6315 - RNA, 80 nt, Sus scrofa
cagccccccuggcucuagcagcacagaaauauuggcaccgggcggagagucugccaguauuggcugugcugccccaggca

SEQ ID NO: 6316 - RNA, 80 nt, Sus scrofa
cugagugaauuagguaguuucauguuguugggccuggauuucugaacacaacgacauuaaaccacccgacucacggcagu

SEQ ID NO: 6317 - RNA, 107 nt, Sus scrofa
uugcucagcugaucuguggcuuagguaguuucauguuguugggauugaguuuugaacucggcaacaagaaacugccugaguuacaucagucgguuaucgucgagggc

SEQ ID NO: 6318 - RNA, 80 nt, Sus scrofa
cuggucggugauuuagguaguuuccuguuguugggauccaccuuucucucgacagcacgacacugccuucauuacuucag

SEQ ID NO: 6319 - RNA, 78 nt, Sus scrofa
gucggugauuuagguaguuuccuguuguugggauccaccuuucucucgacagcacgacacugccuucauuacuucagu

SEQ ID NO: 6320 - RNA, 76 nt, Sus scrofa
uccgucgccccaguguucagacuaccuguucaggacaaugccguuguacaguagucugcacauugguuagacuggg

SEQ ID NO: 6321 - RNA, 80 nt, Sus scrofa
ccccgccaacccaguguucagacuaccuguucagggggcucugaauguguacaguagucugcacauugguuaggcugggc

SEQ ID NO: 6322 - RNA, 74 nt, Sus scrofa
ccgucuacccaguguuuagacuaucuguucaggacucccaaauuguacaguagucugcacauugguuaggcugg

SEQ ID NO: 6323 - RNA, 80 nt, Sus scrofa
cgccguuccgccuuccuaugcauauacuucuuugagggucuggccugaagagguguaggcaugggaaaccggggcgacga

SEQ ID NO: 6324 - RNA, 109 nt, Sus scrofa
ggcuacaguccuucucaugugacucguggacuucccuuugucauccuaugccugagaauauaugaaggaggcugggaaggcaaagggacguucaauugucaucacuggc

SEQ ID NO: 6325 - RNA, 69 nt, Sus scrofa
cucuuguccuucauuccaccggagucugucucauacccaaccagauuucaguggagugaagcucaggag

SEQ ID NO: 6326 - RNA, 80 nt, Sus scrofa
uucccgaggccacaugcuucuuuauauccccauacggauuacuugacuauggaauguaaggaagugugugaucucguuaa

SEQ ID NO: 6327 - RNA, 80 nt, Sus scrofa
cucucagggaagcuuuuugcucgcguuauguuucucauccgaauauaagacgaacaaaagguuugucugagggcagagug

SEQ ID NO: 6328 - RNA, 76 nt, Sus scrofa
gcgcagggcagccacugcccaccgcacacugcgcugcuccggacccacugugcgugugacagcggcugaucugucc

SEQ ID NO: 6329 - RNA, 82 nt, Sus scrofa
gcgcgccggcaccuuggcucuagacugcuuacugcccgggccgcccucaguaacagucuccagucacggccaccgacgccug

SEQ ID NO: 6330 - RNA, 110 nt, Sus scrofa; identical to SEQ ID NO: 2911

SEQ ID NO: 6331 - RNA, 96 nt, Sus scrofa
agagaugguguacaggaaaaugaccuaugaauugacagacaauguggcuaaaucugucugucauuucuguaggccaauauucuguauaucucugcu

SEQ ID NO: 6332 - RNA, 105 nt, Sus scrofa
gauggcugugaguuggcuuaaucucagcuggcaacugugagauguucauacaaucccccacaguggucucugggauuaugcuaaacagagcaauuuccuugcccu

SEQ ID NO: 6333 - RNA, 82 nt, Sus scrofa
ugaguuggcuuaaucucagcuggcaacugugagauguucauacaaucccccacaguggucucugggauuaugcuaaacagag

SEQ ID NO: 6334 - RNA, 107 nt, Sus scrofa
auaauuauuacagaguuuuugaugucgcagauacugcaucaggaacugauuggauaagaauuggucaccaucaguucuuaaugcauugccuucagcaucuaaacaag

SEQ ID NO: 6335 - RNA, 78 nt, Sus scrofa
augucgcagauacugcaucaggaacugauuggauaagaauuggucaccaucaguucuuaaugcauugccuucagcauc

SEQ ID NO: 6336 - RNA, 84 nt, Sus scrofa
agauuuucuguugugcuugaucuaaccaugugguugccagguaugaguaaaacaugguucugucaagcaccauggaacgucacg

SEQ ID NO: 6337 - RNA, 82 nt, Sus scrofa
agauuuucuguugugcuugaucuaaccaugugguugccagguaugaguaaaacaugguucugucaagcaccauggaacguca

SEQ ID NO: 6338 - RNA, 84 nt, Sus scrofa
gggcuuuccuuugugcuugaucuaaccaugugguggaacgauggaaacggaacaugguucugucaagcaccgcggaaagcuccg

SEQ ID NO: 6339 - RNA, 83 nt, Sus scrofa
ccgcggcucuugauuguccaaacgcaauucucgagucuauagcucuggccgagaguugagucuggacgucccgagccgucgcc

SEQ ID NO: 6340 - RNA, 70 nt, Sus scrofa
ugaaccuggcauacaauguagauuucuguguuuguugggcaacagcuacauugucugcuggguuucaggc

SEQ ID NO: 6341 - RNA, 80 nt, Sus scrofa
ugcccucaauggcucaguagccaguguagauccugucauuuguaaucaguagcuacaucuggcuacugggucucugaugg

SEQ ID NO: 6342 - RNA, 81 nt, Sus scrofa
gggcuuucaagucacuagugguuccguuuaguagaagguuuugcauuguuucaaaauggugcccuagugacuacaaagccc

SEQ ID NO: 6343 - RNA, 77 nt, Sus scrofa
gacccuuccggagggccccccccaauccuguugugcuggauucagaggguugggcggaggcuuuccugaaggcucug

SEQ ID NO: 6344 - RNA, 79 nt, Sus scrofa
cgguacuugaagaaaugguuuaccgucccacauacauuuugcauauguaugugggacgguaaaccgcuucuugguaucc

SEQ ID NO: 6345 - RNA, 82 nt, Sus scrofa
gcuaacaaaugcucugacuuuauugcacuacuguacuuuacagcuaccaguccaauaguauugucaaagcaucugagagcag

SEQ ID NO: 6346 - RNA, 80 nt, Sus scrofa
gcuccccuccgccuucucuucccgguucuucccggagucgggaaaagcuggguugagagggcgaaaaaggaagaggggac

SEQ ID NO: 6347 - RNA, 86 nt, Sus scrofa
uugguacuuggagagaggugguccguggcgcguucgcuuuauuuauggcgcacauuacacggucgaccucuuugcgguaucuaauc

SEQ ID NO: 6348 - RNA, 80 nt, Sus scrofa
cuaugccuccccgcauccccuagggcauuggugugaagcuggagacccacugccccaggugcugcuggggguuguagucu

SEQ ID NO: 6349 - RNA, 94 nt, Sus scrofa
agugcuugguuccuaguagguguucaguaaguguuugugacauaauucguuuauugagcaccuccuaucaaucaagcacugugcuagguucugg

SEQ ID NO: 6350 - RNA, 91 nt, Sus scrofa
ucugucuguugggcuggaggcagggccuuugugcaggcggguugugcucagaucgccucugggcccuuccuccagcccagaggcggauuca

SEQ ID NO: 6351 - RNA, 80 nt, Sus scrofa
ggagcgggggggcaggaggggcucagggagaaagugugugccgccccuggcccucucugcccuuccgucccccguuccug

SEQ ID NO: 6352 - RNA, 80 nt, Sus scrofa
uuguuuggguuuguucuagguauggucccagggaucccagaucaaaccaggccccugggccuauccuagaaccaaccuaa

SEQ ID NO: 6353 - RNA, 80 nt, Sus scrofa
cuuuugggcgggggucaagagcaauaacgaaaaauguuugucauaaaccguuuuucauuauugcuccugaccuccucuca

SEQ ID NO: 6354 - RNA, 79 nt, Sus scrofa
ccguccuccccaacaauauccuggugcugagugaugacacacgcaacuccagcaucagugauuuuguugaagagggcag

SEQ ID NO: 6355 - RNA, 80 nt, Sus scrofa
gcagccgccgucccuguccuccaggagcucacuuaccuugggccgugagcuccucgaggccagagcccgugucugccucu

SEQ ID NO: 6356 - RNA, 86 nt, Sus scrofa
uaagacaaggucccuguccuccaggagcucaugguccaauagaagcauauauacaaauggcucugaggggagaucccgcuguggcu

SEQ ID NO: 6357 - RNA, 80 nt, Sus scrofa
uaccuggugugauuauaaagcaaugagacugauugucauaugucguuugugggauccgucucaguuacuuuauagccaua

SEQ ID NO: 6358 - RNA, 84 nt, Sus scrofa
ccuggugugauuauaaagcaaugagacugauugucauaugucguuugugggauccgucucaguuacuuuauagccauaccuggu

SEQ ID NO: 6359 - RNA, 80 nt, Sus scrofa
aaggugagggugcuaucugugacugagggacauggcgcauagaacugucucacacagaaaucgcacccgucaccuuggcc

SEQ ID NO: 6360 - RNA, 80 nt, Sus scrofa
aacccaggucugcugacuccuaguccagugcuugugauggcuggugggcccugaacuaggggucuggaggccuggguuug

SEQ ID NO: 6361 - RNA, 78 nt, Sus scrofa
acccaggucugcugacuccuaguccagugcuugugauggcuggugggcccugaacuaggggucuggaggccuggguuu

SEQ ID NO: 6362 - RNA, 80 nt, Sus scrofa
ggagcuuaucagaaucuccagggguacuuauaauuugaaaaagucccccaggugugauucugauuugcuuccuccuccuc

SEQ ID NO: 6363 - RNA, 79 nt, Sus scrofa
cccccucucaaauccuuggaaccuaggugugagugcugcucuagugcaacacaccuauucaaggauucaaagaggcuga

SEQ ID NO: 6364 - RNA, 80 nt, Sus scrofa
gcuguugucggguggaucacgaugcaauuuugauuaguaucauaggagaaaaauugcacgguauccaucuguaaaccgca

SEQ ID NO: 6365 - RNA, 85 nt, Sus scrofa
uugcuguugucggguggaucacgaugcaauuuugauuaguaucauaggagaaaaauugcacgguauccaucuguaaaccgcagga

SEQ ID NO: 6366 - RNA, 80 nt, Sus scrofa
cgcagggaaaaugagggacuuuugggggcagauguguuuccauuccacuaucauaaugccccuaaaaauccuuauugcuc

SEQ ID NO: 6367 - RNA, 80 nt, Sus scrofa
aaaaaugagggacuuucaggggcagcuguguuuucugacucagucauaaugccccuaaaaauccuuauuguucuugcagu

SEQ ID NO: 6368 - RNA, 149 nt, Sus scrofa
uugaagggagaucgaccguguuauauucgcuuuaugguacuugaagggagaucgaccguguuauauucgcuuggcugacuucgaauaauacaugguugaucuuuucucaguaucugacuucgaauaauacaugguugaucuuuucucag

SEQ ID NO: 6369 - RNA, 80 nt, Sus scrofa
aagacagagaagccaggucacgucucugcaguuacacagcucacgagugccugcugggguggaaccuggucugucugucu

SEQ ID NO: 6370 - RNA, 80 nt, Sus scrofa
caucggccauuauaauacaaccugauaaguguuacagcacuuaucagguuguauuguaauugucuguguauauauaugcc

SEQ ID NO: 6371 - RNA, 80 nt, Sus scrofa
ucggauggauauaauacaaccugcuaaguguccuagcacuuaucagguuguauuaucauuguccgugucuauggcucucg

SEQ ID NO: 6372 - RNA, 80 nt, Sus scrofa
gguauuuaaaagguagauucuccuucuaugaguacauuauuuauuauuaaucauagaggaaaauccacguuuucaguauc

SEQ ID NO: 6373 - RNA, 78 nt, Sus scrofa
uauuuaaaagguggcuauuccuucuauguuuauguuauuugugguuaaacauagaggaaauuccacguuuucaguauc

SEQ ID NO: 6374 - RNA, 78 nt, Sus scrofa
uauuuaaaagguggauauuccuucuauguuuauguuauuugugguuaaacauagaggaaauuccacguuuucaguauc

SEQ ID NO: 6375 - RNA, 80 nt, Sus scrofa
ccacccagggcuccugacuccagguccuguguguugccuggaaauagcacuggacuuggagucagaaggccugcguggag

SEQ ID NO: 6376 - RNA, 68 nt, Sus scrofa
gugggccuccugaaggcaggcagaaccauugggugaaaagagcacuggacuuggagucagaaggcccg

SEQ ID NO: 6377 - RNA, 82 nt, Sus scrofa
ugguacuuaaagcgagguugcccuuuguauauucggguuuugagguggaauauacaaggacaagcucucugugaguaucaaa

SEQ ID NO: 6378 - RNA, 77 nt, Sus scrofa
acuugaagagaaguuguucgugguggauucgcuuuacuuaugacgaaucauucacggacaacacuuuuuucaguacc

SEQ ID NO: 6379 - RNA, 82 nt, Sus scrofa
ccugcuccucagaucagaaggugauuguggcuuuggguagauauuaaucagccacagcacugccuggucagaaagagcaagu

SEQ ID NO: 6380 - RNA, 76 nt, Sus scrofa; identical to SEQ ID NO: 4846

SEQ ID NO: 6381 - RNA, 78 nt, Sus scrofa
acauuguaggccucauuaaauguuuguugaaugaaaaaaugaaucaucaacagacauuaauugggcgccugcucugug

SEQ ID NO: 6382 - RNA, 80 nt, Sus scrofa
aaguuaggcugaggggcagagagcgagacuuuucuauuuuccaaaagcucggucugaggccccucagucuugcuuccuac

SEQ ID NO: 6383 - RNA, 80 nt, Sus scrofa
uccgaggggaugcagcagcaauucauguuuugaagggcuuuaaaugguucaaaacgugaggcgcugcuauacccccucgc

SEQ ID NO: 6384 - RNA, 80 nt, Sus scrofa
aagugcuuuggaaugacacgaucacucccguugagugggcacccaaguagccaucgggaaugucguguccgcccagugcu

SEQ ID NO: 6385 - RNA, 81 nt, Sus scrofa
gccgccgaugggugucuuaccaggcacgguuagaucugguucuucugucuaauacugucugguaaugccguccauucccgg

SEQ ID NO: 6386 - RNA, 80 nt, Sus scrofa
uccaggucuuggaguaggucauuggguggauccuuuauuucccuaugugggccacuggauggcuccuccauggcuuggag

SEQ ID NO: 6387 - RNA, 106 nt, Sus scrofa
gucugucaaagaaagaugcuaaacugguuuugcgauguguuccuaauaugcaguauaaauauauugggagcauuuugcaugcaugguuuuguaucacuauacagau

SEQ ID NO: 6388 - RNA, 80 nt, Sus scrofa
aaaauuauuuuugcaauauguuccugaauauguaauauaaguauauugggaacauuuugcauccauaguuuuguaucgau

SEQ ID NO: 6389 - RNA, 81 nt, Sus scrofa
ggcacuaaacuauuuuugcgauguguuccuaauacguaaucuaaguguauugggaacauuuugcauucguaguuuuguguc

SEQ ID NO: 6390 - RNA, 65 nt, Sus scrofa
ggggguggcgagcaaaccguuaccauuacugaguuuaguaaugguaacgguucucuugcugcacc

SEQ ID NO: 6391 - RNA, 80 nt, Sus scrofa
aagcacuuacaacuguuugcagaggaaacugagacuuuguaacuacaucucagucucaacugcaaagaaguaagugcuua

SEQ ID NO: 6392 - RNA, 80 nt, Sus scrofa
uggcgugaggguaugugccuuuggacuacaucguggaagccagcaccaugcaguccaugggcauauacacuugccucaag

SEQ ID NO: 6393 - RNA, 83 nt, Sus scrofa
gcagccaucgucaggcucaguccccucccgauaaaccccuaaauagggaccuucccagggggcgacccaggcuuuuuuggcaa

SEQ ID NO: 6394 - RNA, 80 nt, Sus scrofa
gcuggggcuucagggccagcucggaccucugaccucccugacggguccuguacugagcugccccgaggcccucacugugc

SEQ ID NO: 6395 - RNA, 82 nt, Sus scrofa
cccugacggguccuguacugagcugccccgaggcccucacugugcccagcucgggccagcucaguacccggcgcgucggggu

SEQ ID NO: 6396 - RNA, 78 nt, Sus scrofa
uacuuggagagugguuaucccuguccuguucguuuuacucaugucgaaucguacagggucauccacuuuuucaguauc

SEQ ID NO: 6397 - RNA, 81 nt, Sus scrofa
uggcagcuugguggucguauguguggcgccaucuacuugagcgguuaggagugacaucacauauacggcggcuaaacugcu

SEQ ID NO: 6398 - RNA, 79 nt, Sus scrofa
uuguucgacaccauggauccccaggugggucacguuucaagauacaccaaccuggaggacuccaugcuguugagcuguu

SEQ ID NO: 6399 - RNA, 81 nt, Sus scrofa
cauuguucgacaccauggauccccaggugggucacguuucaagauacaccaaccuggaggacuccaugcuguugagcuguu

SEQ ID NO: 6400 - RNA, 76 nt, Sus scrofa
uuagcuggguaguggggaacccuuccaugaggaguagaacacuccuuaugcaagauucccuucuaccugacugggu

SEQ ID NO: 6401 - RNA, 83 nt, Sus scrofa
ccccagggccuuguacaugguaggcuuucauucauucguuugcacaugcggugaaggucuacugugugccaggcccugugcca

SEQ ID NO: 6402 - RNA, 75 nt, Sus scrofa
cucgaaggagagguugucguguugucuucucuuuacuuaugaugaaacauacacgggaaaccucuuuuggaguau

SEQ ID NO: 6403 - RNA, 80 nt, Sus scrofa
cccgccccagcagcacacugugguuuguacggcacuguggccacguccaaaccacacugugguguuagagcgaggguggg

SEQ ID NO: 6404 - RNA, 80 nt, Sus scrofa
ugggcgggcggccguuaagacuugcagugauguuuaacuccucuccacgugaacaucacagcaagucugugcugcuuccc

SEQ ID NO: 6405 - RNA, 80 nt, Sus scrofa
ccccucucuaauccuugcuaccugggugagagugcugugugaaugcaaugcaccugggcaaggauucugagagugagagc

SEQ ID NO: 6406 - RNA, 109 nt, Sus scrofa
gccccgcacucagccgugcccuagcagcgggaacaguacugcagugggcgaucgguacucugggguauuguuucugcugcccgggcaaggcugggacucccgccggggc

SEQ ID NO: 6407 - RNA, 80 nt, Sus scrofa
gcuguugggagacccuggucugcacucuaucuguaugcuuacugaagggagcgcagggcaggguuucccacacagagggc

SEQ ID NO: 6408 - RNA, 80 nt, Sus scrofa
gcacucagugggggagccaggaaguauugauguuucugccagguuagcgucaacacuugcugguuuccucucuggagcau

SEQ ID NO: 6409 - RNA, 80 nt, Sus scrofa
uugcuuucucucuuacaugccuugaguguaggaccguuggcaucugaauacccucccacacccaaggcuugcaggagggc

SEQ ID NO: 6410 - RNA, 80 nt, Sus scrofa
ccucagacgucucggggaucaucaugucacgagagaccacugugcacuugugacagauugauaacugaaaggucugggag

SEQ ID NO: 6411 - RNA, 79 nt, Sus scrofa
uuaguaggccucaguaaauguuuauuggaugaauaaaugaaugacucaucaacaaacauuuauugugugccugcuaacg

SEQ ID NO: 6412 - RNA, 80 nt, Sus scrofa
uggugacccuggaaauccagagcgggugaggccugucugacuguuucuaggcgacccacucuugguuuccaugguugccc

SEQ ID NO: 6413 - RNA, 80 nt, Sus scrofa
ugggugcgggcgugugagugugugugugugagugugugucgcuccggguccacgcucaugcacacacccacacgcccgca

SEQ ID NO: 6414 - RNA, 77 nt, Sus scrofa
cucuuugguuacaguuguucaaccaguuacuaaucuaacuaacuguaaccgguugaacaacugaacccaaagggugc

SEQ ID NO: 6415 - RNA, 88 nt, Sus scrofa
gggaggggcgggagggggcuccccggugcucggaucucgagggugcuuauuguucgguccgagccugggucucccucucccccccacc

SEQ ID NO: 6416 - RNA, 80 nt, Sus scrofa
gugucacuuccucaugcugacauauuuacuagaggguaaaguuaacaaccuucuaguaagaguggcagucgaagggaagg

SEQ ID NO: 6417 - RNA, 83 nt, Sus scrofa
uaugcacugcacaacccuaggagagggugccauucacauagacuauaauugaauggcgccacuaggguugugcagugcacaac

SEQ ID NO: 6418 - RNA, 80 nt, Sus scrofa
gaacauugaaacaggcuaggagaagugauuggauagaaaaugguauucuauucauuuaucucccagccuacaaaaagaaa

SEQ ID NO: 6419 - RNA, 80 nt, Sus scrofa
caggaagaggaggaagcccuggaggggcuggaggugauggauguuuuccuccgguucucagggcuccaccuuuuccgggc

SEQ ID NO: 6420 - RNA, 80 nt, Sus scrofa
aacgcgugacucuucaaucucaggacucgcauaauuagcagaaugccguccuaagguuguugaguucugcguuucugggc

SEQ ID NO: 6421 - RNA, 76 nt, Sus scrofa
aacgcgugacucuucaaucucaggacucgcauaauuagcagaaugccguccuaagguuguugaguucugcguuucu

SEQ ID NO: 6422 - RNA, 80 nt, Sus scrofa
cccucaaggagcuuacaaucuagcugggggugaaugacuugcacaugaacgcaacuagacugugagcuucuagagggcag

SEQ ID NO: 6423 - RNA, 80 nt, Sus scrofa
gcagggugcggggcuagggcuaacagcagucuuacugaagguuuccuggaaaccacgcacaugcuguugccacuaaccuc

SEQ ID NO: 6424 - RNA, 76 nt, Sus scrofa
gguacaugaggugguugaccagagagcacacgcuuuauugugccguuugugaccugguccacuaacccucaguauc

SEQ ID NO: 6425 - RNA, 80 nt, Sus scrofa
ugcgcucugaccugagaccucuggguucugagcugugauguugcuuccaagcugggaucucuggggucuugguucagggu

SEQ ID NO: 6426 - RNA, 84 nt, Sus scrofa
ugguguuagcccugcggccccacgcaccaggguaagagagacucucgcuuccugcccuggcccgagggaccgacuggcugggcc

SEQ ID NO: 6427 - RNA, 80 nt, Sus scrofa
cacucggcccgcgcucucuccauuacacuacccugccucuucuccacgagaggcagcgggguguaguggauagagcacgg

SEQ ID NO: 6428 - RNA, 80 nt, Sus scrofa
ggcgcaggcggcaguggcgggagcggccccucggccauccuccgucugcccaguuaccgcuuccgcuaccgccgccgcuc

SEQ ID NO: 6429 - RNA, 108 nt, Sus scrofa
ccuacccuuggugaggacucgggagguggaggguggcgcugccagggccagggcacugucucagcucgcuucuccccccaccuccucucuccucaggugcgguugcag

SEQ ID NO: 6430 - RNA, 82 nt, Sus scrofa
uguuugcauggggaggagggaggagaugggccaaguucccucugccuggaacgcccuucccccccuucuucaccuagcgaac

SEQ ID NO: 6431 - RNA, 82 nt, Sus scrofa; identical to SEQ ID NO: 6430

SEQ ID NO: 6432 - RNA, 78 nt, Sus scrofa
uagaucagugcuuggcaccuaguaagcacucaguauauacuuguugagugccugcuaugugccaggcauugugcugag

SEQ ID NO: 6433 - RNA, 80 nt, Sus scrofa
uagccucccaaauauauauauauauguacguauguguauaugaauguauacguagauauauauguauuuuugguggguuu

SEQ ID NO: 6434 - RNA, 80 nt, Sus scrofa
gcugaucaguagugggaucgcgccugugaauagccacuguacuccagccugggcaacauagcgagaccccgucucuuuug

SEQ ID NO: 6435 - RNA, 85 nt, Sus scrofa
ccuaacuggguuagggcccuggcuccaucuccuuuaggaaaaccuucuguggggagugggguuuugacccuaacccagcugggcu

SEQ ID NO: 6436 - RNA, 80 nt, Sus scrofa
gucuccaccaccuccccugcaaacguccagugaugcagagguaauggacguuggcucugguggugauggacaggccgaac

SEQ ID NO: 6437 - RNA, 80 nt, Sus scrofa
cuaccaaucucgaccggaccucgaccggcucgucuauguugccaaucgacucggcguggcgucggucgugguagauaggc

SEQ ID NO: 6438 - RNA, 79 nt, Sus scrofa
gcuucggugcuggggagcggcccccgggcgggccucugcucuggccccuccuggggcccgcacucucgcuccggguccg

SEQ ID NO: 6439 - RNA, 83 nt, Sus scrofa
ugggugguuucuccguuugccuguuuugcugacguucauuugacucauucucagcaaaauaagcaaauggaaaauucauccau

SEQ ID NO: 6440 - RNA, 80 nt, Sus scrofa
ccuaaaugaaaagguagauagaacaggucuuguuugcaagaugaauucaagaccuacuuuucuaccaacagcaauuacac

SEQ ID NO: 6441 - RNA, 81 nt, Sus scrofa
gcuguccccauggcacaggguccagcugucggcuguaauacccgaugggucgaugauggucccuguguuuggggcgagcac

SEQ ID NO: 6442 - RNA, 83 nt, Sus scrofa
gcccuggccccaggguccucuugucugagccccagaaagaggagagagcgcugggucacagaagagggucugggggacagguu

SEQ ID NO: 6443 - RNA, 83 nt, Sus scrofa; identical to SEQ ID NO: 6442

SEQ ID NO: 6444 - RNA, 83 nt, Sus scrofa
agaggcaauguggagugacugucagaugcagccaucagaauaggugauuuggcugaacugucauacucccacauccuccacca

SEQ ID NO: 6445 - RNA, 76 nt, Sus scrofa
ugaaaaguuccgucaaccauccagcuguuuggggugaugcaaacaaacaucugguugguugagagaauuuuuuacu

SEQ ID NO: 6446 - RNA, 77 nt, Sus scrofa
ggguuuggauuguuguacuuuuuuuuuuguucguugcauuuuuaggaacaaaaaaaaaagcccaacccuucacaccg

SEQ ID NO: 6447 - RNA, 80 nt, Sus scrofa
ccaugagcuauggcguagaucacagacacagcucagaucuggcauugcuguggcugugguguaggccagcagcuuugcuc

SEQ ID NO: 6448 - RNA, 107 nt, Sus scrofa
cggcggggggugucgcgggggugggcgggcuggggccggggguggggccggcgggggcacgacccccggucggcguccacggccgccgccgggcgccuuuccaccgc

SEQ ID NO: 6449 - RNA, 69 nt, Sus scrofa
cugugcugagcccuggagugacgggggugaaagggcagagucccuguccuccaggagcuccccaugugg

SEQ ID NO: 6450 - RNA, 64 nt, Sus scrofa
ccucuuccagccccacguugggcgccacucugcugugcccagcgcugcagggcaauagggaagc

SEQ ID NO: 6451 - RNA, 78 nt, Sus scrofa
ggcacuagacaggguauauaagccuucacugguuaaaucaacauacagugaaggcuuauauaucuugucuagugccca

SEQ ID NO: 6452 - RNA, 78 nt, Sus scrofa
aucucucgagauguucagucucagugggaaccguguguaagucuuguucccauugagacugagcaucucaagggauca

SEQ ID NO: 6453 - RNA, 80 nt, Sus scrofa
cugugcuccggcucugagcugccccuccucguccguccccuccagcuggagaggagccgcgacagagccggagcaguggc

SEQ ID NO: 6454 - RNA, 62 nt, Sus scrofa
auguccgcggguucccuaucccggguugguugaguucgcggaugcggaaccugcggauacgg

SEQ ID NO: 6455 - RNA, 59 nt, Sus scrofa
ucucugagacacugacuguggggguauguguguguccaucugucugugucucugagcag

SEQ ID NO: 6456 - RNA, 60 nt, Sus scrofa
ucugguccagacacuguggagcugaagagaccaacacuucucaguguuugaaccagaagc

SEQ ID NO: 6457 - RNA, 60 nt, Sus scrofa
cgggggaacucccagaccagcuuccacucccuucaagaagcuggucugggaguucccggg

SEQ ID NO: 6458 - RNA, 59 nt, Sus scrofa
ucccagcaaguguccauccaucucuguguccauaagagaggacuggccuugcagggugc

SEQ ID NO: 6459 - RNA, 60 nt, Sus scrofa
ccauuccuucgucugugcacuagaaaaauaacaguaccuagggcacaggaugggaugagg

SEQ ID NO: 6460 - RNA, 61 nt, Sus scrofa
caacucaagggggcaucauucacuucauagucucugugaaugaugccccuuagaguugagc

SEQ ID NO: 6461 - RNA, 70 nt, Sus scrofa
gacgguuuggacguuaagaacaauucauauauuuuauuauaugaauccuucuuaacguccaaaccguucc

SEQ ID NO: 6462 - RNA, 60 nt, Sus scrofa
acucuccgaggggccuucaagggcaaguucuugucaccuuuguuggcuccucugaaguga

SEQ ID NO: 6463 - RNA, 61 nt, Sus scrofa
aagcucagcucugaagugcagaggcuguuugcacuuccucugcacuugaagcugagacuga

SEQ ID NO: 6464 - RNA, 54 nt, Sus scrofa
acuuucccgggauuuggagcgcuuccgcacgcgcuccuugucccgagaccgcga

SEQ ID NO: 6465 - RNA, 100 nt, Oryza sativa
ggagggugacagaagagagugagcacacgugguuguuuccuugcauaaaugaugccuaugcuuggagcuacgcgugcucacuucucucucugucaccucc

SEQ ID NO: 6466 - RNA, 176 nt, Oryza sativa
uugucuugagaggggaagagaucucuauggguuuuggaggucugacagaagagagugagcacacacggugcuuucuuagcaugcaagagccaugcugggagcugugcgugcucacucucuaucugucagccguucaccaugcccaauaugauuaaucuccuucucucaguugacag

SEQ ID NO: 6467 - RNA, 149 nt, Oryza sativa
ggaggaagagaggggugagaggugaggcugacagaagagagugagcacacauggugacuuucuugcaugcugaauggacucaugcuugaagcuaugugugcucacuucucucucugucagccauuugaucucucuuucucucuuucucc

SEQ ID NO: 6468 - RNA, 129 nt, Oryza sativa
ggagaagcucucaugagauugacagaagagagugagcacacggcgugauggccggcauaaaaucuaucccguccucgccgcgugcucacuccucuuucugucacccucuuucucucagggcucaacucc

SEQ ID NO: 6469 - RNA, 104 nt, Oryza sativa
ggcgcgaggugacagaagagagugagcacacggccgggcgugacggcaccggcgggcgugccgucgcggccgcgugcucacugcucuuucugucauccggugcc

SEQ ID NO: 6470 - RNA, 186 nt, Oryza sativa
aguugacagaagagagugagcacacagcggccagacugcaucgaucuaucaaucuucccuucgacaggauagcuagauagaaagaaagagaggccgucggcggccauggaagagagagagagagagagaugaaaugaugaugaugauacagcugccgcugcgugcucacuucucuuucugucagcu

SEQ ID NO: 6471 - RNA, 116 nt, Oryza sativa
ggcugacagaagagagugagcacacagcgggcagacugcaucugaauuaccuguugcgacgaagaagacgacggacgcagcuugccguugcgugcucacuucucucucugucagcu

SEQ ID NO: 6472 - RNA, 186 nt, Oryza sativa; identical to SEQ ID NO: 6470

SEQ ID NO: 6473 - RNA, 90 nt, Oryza sativa
ggugacagaagagagugagcacacggccgggcggaacggcaccggcggaugugccgucgcggccgcgugcucacugcucugucugucauc

SEQ ID NO: 6474 - RNA, 165 nt, Oryza sativa
uuggggcggggcgggaucgagcauaugaaaggcgagauuguugacagaagagagugagcacacggcgcggcggcuagccaucggcgggaugccugcccccgccgcgugcucgcuccucuuucugucagcaucucucaucacucccucccgcaucccccgccccga

SEQ ID NO: 6475 - RNA, 106 nt, Oryza sativa
uugagagugaugacagaagagagagagcacaacccggcagcagcgacgacggcggucgcuucugccagggccgugugcucucugaucuaucugucauugccgucca

SEQ ID NO: 6476 - RNA, 156 nt, Oryza sativa
gcuagggagccgacagaagagagugagcauauauaguucuuuccuugcauauguggucauauguguguugacugaagagauacauauauauagagagagagaguucaugugcuugaagcuauaugugcucacuucucuuucugucagcaaauuauc

SEQ ID NO: 6477 - RNA, 272 nt, Oryza sativa
guuguggacguugagcuccuuucgguccaaaaagggguguugcugugggucgauugagcugcugggucauggaucccguuagccuacuccauguucaucauucagcucgagaucugaaagaaacuacuccaauuuauacuaauaguauguguguagauaggaaaaugauggaguacucguuguugggauaggcuuauggcuugcaugccccaggagcugcaucaacccuacauggacccucuuuggauugaagggagcucugcaucuuuugu

SEQ ID NO: 6478 - RNA, 188 nt, Oryza sativa
gguuaugaaguggagcuccuuucguuccaaugaaagguuuaucugaagggugauacagcugcuuguucaugguucccacuauucuaucucauaggaaaagagauaggcuugugguuugcaugaccaaggagccgaaucaacuccuugcugaccacucuuuggauugaagggagcucugcaucuugauc

SEQ ID NO: 6479 - RNA, 197 nt, Oryza sativa
gaggaggaagaggagcuccuuucgauccaauucaggagaggaagugguaggaugcagcugccgauucauggauaccucuggagugcauggcagcaaugcuguaggccugcacuugcauggguuugcaugacccgggagaugaacccaccauugucuuccucuauugauuggauugaagggagcuccacaucucucuc

SEQ ID NO: 6480 - RNA, 189 nt, Oryza sativa
ugaugugaggaggagcuccuuucgauccaauucaggagaggaaguggugggaugcagcugccgguucauggauaccucugcaguucaugccgguaggccugcacuugcauggguuugcaugaccugggagaugaaccugccauuguguuccucuauugauuggauugaagggagcuccggcuacaccua

SEQ ID NO: 6481 - RNA, 191 nt, Oryza sativa
gaugaagaagaagagcucccuuucgauccaauucaggagaggaagugguaggaugcagcugccgguucauggauaccucuggagugcagggcaaauaguccuacccuuucauggguuugcaugacucgggagaugaacccgccauugucuuccucuauugauuggauugaagggagcuccucuagcuacau

SEQ ID NO: 6482 - RNA, 188 nt, Oryza sativa
gaagaagaagacgagcucccuucgauccaauccaggagaggaagugguaggaugcagcugccgguucauggauaccucugcagugcaugucguaggcuugcacuugcauggguuugcaugacccgggagaugaacccaccauugucuuccucuuaugcuuggauugaagggagcucuacaccucucuc

SEQ ID NO: 6483 - RNA, 88 nt, Oryza sativa
gugugccuggcucccuguaugccacacauguagaccaacccauggugucugguugccuacuggguggcgugcaaggagccaagcaugc

SEQ ID NO: 6484 - RNA, 139 nt, Oryza sativa
aagguuugguuuugaucggcuugagagcgugccuggcucccuguaugccacucauguagcccaauccaugguguguuuggaugcuguggguggcgugcaaggagccaagcaugcgugccaugaucucucuuucugccuu

SEQ ID NO: 6485 - RNA, 99 nt, Oryza sativa
ggaaugugccuggcucccuguaugccacucaucuagagcaacaaacuucugcgagagguugccuaugauggauggcgugcacggagccaagcauauucc

SEQ ID NO: 6486 - RNA, 142 nt, Oryza sativa
ggggauaugccuggcucccuguaugccacucgcguagcugccaaacucaguugaaacaacugccuucucccggcgagauucaggcauuguguucguacguuuggcucuacugcggauggcgugcgaggagccaagcaugacc

SEQ ID NO: 6487 - RNA, 114 nt, Oryza sativa
guaggggauaugccuggcucccuguaugccgcucgcauggcugccaacccaaugaacucgaucucguuguuggccgcugcguacggcgugcgaggugccaagcauggcccucuu

SEQ ID NO: 6488 - RNA, 100 nt, Oryza sativa
ggauuaacgcugccuggcucccugaaugccauccgagaagcgugccgcuguggccggcugcuuccugguuggcauugagggagucaugcaggguuugcuc

SEQ ID NO: 6489 - RNA, 171 nt, Oryza sativa
ggugaugccugggcgcagugguuuaucgaucccuucccugccuuguggcgcugauccaggagcggcgaauuucuuugagaggguguucuuuuuuuuucuuccuuuugguccuuguugcagccaacgacaacgcgggaaucgaucgauaaaccucugcauccaguucucgcc

SEQ ID NO: 6490 - RNA, 134 nt, Oryza sativa
ugggugaugccugggcgcagugguuuaucgaucucuucccugccuugugcugcuccgaucgaugcccgugcugauucuugauaauauacaacgcaggaaucgaucgauaagccucugcauccagaucucacuuu

SEQ ID NO: 6491 - RNA, 156 nt, Oryza sativa
gugagaaggaccgcguuggagaagcagggcacgugcaugcauauguucaucaucaucuucuuccuccuccucuagcuccagccuuguguggguuggaaguuuagauagaacucgcacugcacguggucuccuucuccaucccggucuuuuucucac

SEQ ID NO: 6492 - RNA, 109 nt, Oryza sativa
gugcacgguggagaagcagggcacgugcauuaccauccacucgccugccggccgccggccgccauugccauggaugguucuucaugugcccgucuucuccaccgagcac

SEQ ID NO: 6493 - RNA, 119 nt, Oryza sativa
agguucuuguuggagaagcaggguacgugcaaaaugcacaccgguuggucgagcuaauuaacaagcucugacgaccauggugaucgaaugcacgugcuccccuucuccaccauggccuu

SEQ ID NO: 6494 - RNA, 94 nt, Oryza sativa
caaaccgugcuggagaagcagggcacgugcucgacggcggggcuggcuggccggccggcuugcagcaugugcgcuccuucuccagcauggcuuc

SEQ ID NO: 6495 - RNA, 132 nt, Oryza sativa
uugugcaggguggagaagcagggcacgugagcggccauccaguguagcuucgcugcgcguccauggcggcgaacgcgcgugaucuggaguuuggauggucguucauguguccgucuucuccaccgagcacug

SEQ ID NO: 6496 - RNA, 210 nt, Oryza sativa
ugaggauggcgaggcgcgcgagguggagaagcagggcacgugcauuccuagagcuuccguccagcuccccggcgggcuagcuagcucacuccgccgccgccgccgccgccgccggcgcgcgcacggcuggcuggcuccggccggcugagaugcaugcacggaugcaugugcccuucuucuccaccgugcacgccucgccugcagcaagga

SEQ ID NO: 6497 - RNA, 145 nt, Oryza sativa
ugaagcuauuugcuucugaguggaauguugucugguucaaggucucaugcaccuugcgguuuugaggaugauuugugcaagguuuuucauuccucucauccgugggaucucggaccaggcuucauuccccucagagauagcuuca

SEQ ID NO: 6498 - RNA, 206 nt, Oryza sativa
gggagccuuuucauuuugaggggaauguugucuggcucggggcuacuuuuaauuucucucucuuuugauaucuucuuuucucgaucuccuagcuugaucuuuugaucucucaaaucgaucuuaagaaaaagaucagucaaagagaugagaguagaugucuguagaucucggaccaggcuucauuccccccaaacagaagggcuccc

SEQ ID NO: 6499 - RNA, 125 nt, Oryza sativa
ggcaguugaggggaauguugucugguccgagaccuaacaccgggcggaauggcggauucagcugcagcuaagcaagcuaggugggggguuucggaccaggcuucauuccccccaacucaacuguu

SEQ ID NO: 6500 - RNA, 125 nt, Oryza sativa
gaagcuuuuucacuuugaggggaauguugucuggcucgaggugcauggagaaaccucugaucgaucagguuugaucuguagagacugaucucggaccaggcuucauuccccucaaguaaagcucc

SEQ ID NO: 6501 - RNA, 137 nt, Oryza sativa
uguuucuggguggaauguugucugguucaaggccccuuaggaugugugauuuuugaugguuuaugcauucaucuugaugcgaacaucuaucucggaucuuuggguucucgaaccaggcuucauuccccucagagaua

SEQ ID NO: 6502 - RNA, 107 nt, Oryza sativa
cgaucaucuuguugagaggaaugucgucuggccugagaucguaccacagugguggguacacguggacggucucggaccaggcuucauuccccucaacaacucgucgg

SEQ ID NO: 6503 - RNA, 145 nt, Oryza sativa
agcauggugucuggaauggaggcugauccaagaucauugcuuggugcaaaauacuagggcauuguuguaagugccauuaguucuuuuuuguuuccgaguuuguuaucgaggaucucggaccaggcuucauuccucacaccgugcu

SEQ ID NO: 6504 - RNA, 119 nt, Oryza sativa
gguggcuuguggggaauguuggcuggcucgagguauccacaucuuaauuccucuccggcgaucgagccggcucgggcguguggaagcgucggaccaggcuucauuccucgcaagccgau

SEQ ID NO: 6505 - RNA, 145 nt, Oryza sativa
agauagguguuuggaaugcaguuugauccaagaucugccuauauauaugguguguauaucauaucuugugauaugggggauaugcaacaggugugugacagggguagguagaucucggaucaggcuucauuccucacaccaauac

SEQ ID NO: 6506 - RNA, 100 nt, Oryza sativa
ugauccauggcuguugagaggaaugacguccggucugaagaucgccguccccaggcgguggcuucggaccaggcuucauuccccaugacucauggaaccc

SEQ ID NO: 6507 - RNA, 127 nt, Oryza sativa
auuagguuaagggguuuguugucuggcucgaggcauccgggacuccgguuucuccuuuccuacuggaggcgccuaauuuccggcgagcucggagccucggaccaggcuucaaucccuuuaaccaugc

SEQ ID NO: 6508 - RNA, 117 nt, Oryza sativa
guuagguuaaggggauuguugucugguucaaggucuccacauugugcaaaauguucauucauggaggcacaggaugcuuggugaucucggaccaggcuucaaucccuuuaaccagca

SEQ ID NO: 6509 - RNA, 200 nt, Oryza sativa
cucugcuuuggugguuggcugauguucucgguuaagggguuuguugucugguucaaggccuccugcuguccuacaucacauuuuuuuuucuuuguucugaauuucugauggaugugugugugcaugaugcauggcugguggugaccucggaccaggcuucauucccuuuaaccagcauuugcguuaauaccaucaggcau

SEQ ID NO: 6510 - RNA, 141 nt, Oryza sativa
uagugugaaugagugaagcugccagcaugaucuagcucugauuaaucggcacuguuggcguacagucgauugacuaaucgucagaucuguguguguaaaucacuguuagaucaugcaugacagccucauuucuucacacug

SEQ ID NO: 6511 - RNA, 163 nt, Oryza sativa
gugcccaagagaaagcgugaagcugccagcaugaucuaacuugcagacaagaaaucagcucagcucgcugguuucgaacaggaaggcggcuagcugaggcuucuucugaguacgugaugguuagaucaugcugugacaguuucacuccuucccuguugggcac

SEQ ID NO: 6512 - RNA, 163 nt, Oryza sativa
uguccaagggaacgagugaagcugccagcaugaucuagcucugaaugaucaacaagaugugcucccacacugccuuccuguggaucuugagcuguugcuagucuuguggucaugccuugcuaggucaugcugcggcagccucacuucuucccauuguugggca

SEQ ID NO: 6513 - RNA, 110 nt, Oryza sativa
cauuaggagcugaagcugccagcaugaucugaugagugcuuauuaggugagggcagaauugacugccaaaacaaagaucagaucaugcugugcaguuucaucugcuugug

SEQ ID NO: 6514 - RNA, 273 nt, Oryza sativa
ugugagagaaugaagcugccagcaugaucugguugucaggcaugagccaaaucuauccaugguguuggugguacugaaauuaccgcguuuucgagguuuuucgucgugucaacuugcgaagggaauuacggguucuugaugagcauuggugauaggaggugugggcuugguuaguagagguagaauuaugauuguucuugugaguuucaguaagaggugggagugauuggaauuuggcuccaucagaucauguugcagcuucacucucucacc

SEQ ID NO: 6515 - RNA, 113 nt, Oryza sativa
cacaaguggaugaagcugccagcaugaucugaucacaguaguucucuagcugaugaugauuuacaaaaccuagagacaugcaucagaucaucuggcaguuucaucuucucaug

SEQ ID NO: 6516 - RNA, 82 nt, Oryza sativa
cauaagcaggugaagcugccagcaugaucugaaagcaucucaaaccagcgaucagaucauccggcagcuucaucuucucaug

SEQ ID NO: 6517 - RNA, 120 nt, Oryza sativa
cacaaguuggugaagcugccagcaugaucugaugaugaugaugauccaccucucucaucuguguucuugauuaauuacggaucaaucgaucaggucaugcuguaguuucaucugcugguu

SEQ ID NO: 6518 - RNA, 201 nt, Oryza sativa
ugugagaggcugaagcugccagcaugaucugguccaugaguugcacugcugaauauauugaauucagccaggagcugcuacugcaguucugaucucgaucugcauucguuguucugagcuauguauggauuugaucgguuugaaggcauccaugucuuuaauuucaucgaucagaucauguugcagcuucacucucucacu

SEQ ID NO: 6519 - RNA, 160 nt, Oryza sativa
uugugaugugugcaccuuaagcagcugaagcugccagcaugaucugaucuuuugcgaucucuuuuuuuaucugaauaaguugauggaaauauuggguuccuaagauucagaucgugcugcgcaguuucaucugcuaaucgaugcacuacacugugaauuu

SEQ ID NO: 6520 - RNA, 87 nt, Oryza sativa
cgccucgggcucgcuuggugcagaucgggacccgccgccgccgcugccggggccggaucccgccuugcaccaagugaaucggagccg

SEQ ID NO: 6521 - RNA, 106 nt, Oryza sativa
uggucuugugaggcuuggugcagcucgggaacuguucuugauggacuggcaggaacuccauguccaccacugccacuccuguguuguggcauuccuccuugccguu

SEQ ID NO: 6522 - RNA, 173 nt, Oryza sativa
cgccggcggccugacauugggaucggaggccauggugcagccaaggaugacuugccgaucgaucgaucuaucuaugaagcuaagcuagcuggccauggauccauccaucaauuggcaaguuguucuuggcuacaucuuggccccugcuccucauguaaggccggccuguggcg

SEQ ID NO: 6523 - RNA, 128 nt, Oryza sativa
gaacggaaugcagccaaggaugacuugccgguacguguaugcauguuucaagguacuauaugugcccccaacuguuuuagauccaugcugacauuuuccggcaaguuguccuuggcuacgucuuguuc

SEQ ID NO: 6524 - RNA, 112 nt, Oryza sativa
gaacgggaugcagccaaggaugacuugccggcuccugguauugggggaaucucagcuuugcugaagcgccuuggaguuagccggcaagucuguccuuggcuacaccuagcuc

SEQ ID NO: 6525 - RNA, 103 nt, Oryza sativa
auuuaucguguagccaaggaugaauugccggcguuucacgcuguugauggugcgugcauauauaaguuggcgccggcaagucauuucaggcuacauguuugcc

SEQ ID NO: 6526 - RNA, 132 nt, Oryza sativa
gcugguuguguagccaaggaugacuugccggccugguuuguguucaucagcaauccagcauaugcuguauugccgugugugaucgaucgaugcauggaccggcaaguuauuuucuuuggcuacauuacaacc

SEQ ID NO: 6527 - RNA, 214 nt, Oryza sativa
gggccuuccaugaggacaagagcugauucgguagccaaggaugacuugccuaaugccuaugugcauguguuuauacgcugcucaucugcauuuugauuauccccugaucaguccugucgucaauuauauguguguguaguacucuguacucauacauauauaggcaugucuuccuuggcuauucggagcggcucuugucucucguggaaggcug

SEQ ID NO: 6528 - RNA, 126 nt, Oryza sativa
cugccucugguagccaaggaugacuugccuauugugcucuucugaaugaugcagugccaugaucaguguggccuggcugguucagaugagccgagauaggcagucuccuuggcuagccugaguggc

SEQ ID NO: 6529 - RNA, 122 nt, Oryza sativa
uuagcucugguagccaaggaugacuugccuguguccuuguguguaaggaucauuaauuauuauucagaaaaugauccuuucagcagguuucaugggcagucuccuuggcuagccugagugau

SEQ ID NO: 6530 - RNA, 176 nt, Oryza sativa
ggaagagagcaaggcuugcauggugauaaggguguagcucugguagccaaggaugacuugccuguguccuuguguagaggaucauucagaaaaugagccuugaacugguucauaggcagucuccuuggcuagucugagucgcucuuaucacucauguuaggcuugcaucucguuga

SEQ ID NO: 6531 - RNA, 125 nt, Oryza sativa
ucgcaucugguagccaaggaugacuugccugugucucugcucaugugcaguagaagaagaugcauuucuagcugcuuucugcauaugugaucucacaggcagucuccuuggcuagccugagcggc

SEQ ID NO: 6532 - RNA, 156 nt, Oryza sativa
ucugucuagauagccaaggaugacuugccuguggccucuuggagagagagguguagcuuaauuagcagcaugguuugagcauugcuugaucgguugaucgcuucgcuugcucugcaugagaucuuacaggcagucuccuuggcuagucugggcggc

SEQ ID NO: 6533 - RNA, 108 nt, Oryza sativa
uuaucucugauagccaaggaugacuugccuguguccucccugaaggauuagcaauuuaaugauccuuuaagcugguucaugggcagucuccuuggcuagccugagugg

SEQ ID NO: 6534 - RNA, 138 nt, Oryza sativa
ugaguccugguagccaaggaugacuugccuguauauuuauauauauaugugugugugaucaauggauggauugaucaagcugcuugcaggcucaugcauauauauguacaggcagucuccuuggcuagcccggcuacc

SEQ ID NO: 6535 - RNA, 177 nt, Oryza sativa
cucccuuugguagccaagaaugacuugccuauguguuuugccuuguguuggcucauccauccaucuaucagccguugcagauuugcaguggcagauuaaaggguuucagaaagaaauucuugugauggaugugcaauguggcugcaugggccggucuucuuggcuagccagaguggc

SEQ ID NO: 6536 - RNA, 173 nt, Oryza sativa
cucccuuugguagccaagaaugacuugccuacgcuuuugcccucuguuggcucauccauccgucuaucuaucugccauggcagauggcagauuaaggguuucugaaagaaauucuugugauaggaugugcaaugaggcugcaugggccggucuucuuggcuagccagaguggc

SEQ ID NO: 6537 - RNA, 126 nt, Oryza sativa
gagcaagguguagccaaggacaaacuugccggaucaacagagaaggacugccagucuccggccaauuaauuaaccucgccgucggccaucgccggccggcaagucauccuuggcugcauccugcuc

SEQ ID NO: 6538 - RNA, 108 nt, Oryza sativa
ccacucaggcuagccaaggagacugcccaugaaccagcuuaaaggaucauuaaauugcuaauccuucagggaggacacaggcaagucauccuuggcuaucagagauaa

SEQ ID NO: 6539 - RNA, 129 nt, Oryza sativa
aggccaucuucgauagccaaggaugauuugccuguagccccauugucaucagcucucuccgucgagagcgacaaccgggcucuacuggcaagucuccucggcuacccgaguaccucuuaugcuauccca

SEQ ID NO: 6540 - RNA, 96 nt, Oryza sativa
ggaaagagcgauauuggugagguucaauccgaugauugguuuuacagcagugguaaaaucaguaucugauugagccgcgccaauaucucuuccucu

SEQ ID NO: 6541 - RNA, 100 nt, Oryza sativa
gcgacgacgggauauuggggcgguucaaucagaaagcuugugcuccggaagcgaggagcucuacucuuuugauugagccgugccaauaucacgucgcauc

SEQ ID NO: 6542 - RNA, 99 nt, Oryza sativa
gugggaacgggauauuggugcgguucaaucagaaagcuugugcuccgaaggcgaggggcuccacucuuugauugagccgugccaauaucacgucgccuu

SEQ ID NO: 6543 - RNA, 135 nt, Oryza sativa
uuguagcuaugauguuggcccggcucacucagauggaucaucggugcagaagagugcaugaaucugaugcagucucaguguaguaugcuccaugcuggaacuucugauugagccgugccaauaucucagcaccau

SEQ ID NO: 6544 - RNA, 119 nt, Oryza sativa
ugguagcuaugauguuggcucggcucacucagacggcauuggcgugaugcaaagcaugcaugcgugcuugcuagcucacuuguguuucugauugagccgugccaauaucuuagugcucu

SEQ ID NO: 6545 - RNA, 127 nt, Oryza sativa
gggagagugcgauguuggcaugguucaaucaaaccgggcaaacuuaugcacuagcuaagcaagaugcagggauaugcaguaugguuuuguuuggucugauugagccgugccaauaucacaagcuugc

SEQ ID NO: 6546 - RNA, 89 nt, Oryza sativa
gacauggcaugguauugacuuggcucaucucagcaacagcaaacugcaugcagcgcuggaggugagccgagccaauaucacuucauguc

SEQ ID NO: 6547 - RNA, 101 nt, Oryza sativa
agaagaagaggacaugguuugguauuguuucggcucaugucguucacacagaugugagccgaaccaauaucacucauguauucuucauucagagaacuucu

SEQ ID NO: 6548 - RNA, 120 nt, Oryza sativa
uaaaaagagguauuggcgugccucaauccgaaggcauggcugauuacaggcaccucgaccgaucuagcgcaugcagccauguuucuuggauugagccgcgucaauaucucuccuugcuuc

SEQ ID NO: 6549 - RNA, 109 nt, Oryza sativa
guguuugcgggcguggcaucaucaagauucacauccaugcauauaucacaagacgcacauauacauccgauuuggcugagaaucuugaugaugcugcauccgcagacaa

SEQ ID NO: 6550 - RNA, 238 nt, Oryza sativa
gugauuucugacguggcaucaucaagauucacacauuacauugcaugcaugcauaugucuaugcaucuuugagcuuguuguucugaucucaacaaccuagcuagcuaauauuucucuccuggcccugaccugcaugaugcaugguugcacgcauggagagagaagagagagaucgaagcuaauuaaacgcauguguauauaugugugggaaucuugaugaugcugcaucggaaauuaa

SEQ ID NO: 6551 - RNA, 111 nt, Oryza sativa
cuuguugcgggugcagcgucaucaagauucacgugugccgcacggcacacguaucgguuuucaaguguagucaucgugcgugaaucuugaugaugcugcaccagcaaagag

SEQ ID NO: 6552 - RNA, 130 nt, Oryza sativa
aaacagucggugcuugcaggugcagcaccaucaagauucacaucgaguucaucccuaaacgagaucgagguuggcugacuauaugugaugagaaucuugaugaugcugcaucagcaaacgcucgacuacu

SEQ ID NO: 6553 - RNA, 191 nt, Oryza sativa
uguguaagaagagagcucucuucaguccacucucagauggcuguaggguuuuauuagcugccgaaucauccauucaccuaccaagaaaguugcaggaguguaucucuugguagcggacuggaugacgcgggagcuaaaauuuagcucugcgccguuugugguuggacugaagggugcucccuugcucaagc

SEQ ID NO: 6554 - RNA, 197 nt, Oryza sativa
gauggauggaagagagcguccuucaguccacucaugggcggugcuagggucgaauuagcugccgacucauucacccacaugccaagcaagaaacgcuugagauagcgaagcuuagcagaugagugaaugaagcgggagguaacguuccgaucucgcgccgucuuugcuuggacugaagggugcucccuccuccucga

SEQ ID NO: 6555 - RNA, 91 nt, Oryza sativa
gguauggaacaauccuugaagcucaggagggauagcgccucgaaaucaaacuaggcgcuaucuauccugagcuccaugguuuguucuuacc

SEQ ID NO: 6556 - RNA, 115 nt, Oryza sativa
uggggaagcauccaaagggaucgcauugauccuucaucgcucucgcucgcuuccauggcggucgucgucuacaagcagcuugacggaucaugcgauccuuuuggaggcuuccucu

SEQ ID NO: 6557 - RNA, 132 nt, Oryza sativa
ucggccugaggaaacuaguggaggacuccaaagggaucgcauugaucuggcuagcuaucucgaucgaucgccucaucgaucgacgacgacgugcgugaucgaucagugcaaucccuuuggaauuuuccucuu

SEQ ID NO: 6558 - RNA, 110 nt, Oryza sativa
uacugagaguucuuuggcauucuguccaccuccuugucgaauccucagagacagaaaucucauaucuguugaucuuggaggugggcauacugccaauggagcuguguagg

SEQ ID NO: 6559 - RNA, 142 nt, Oryza sativa
uuguccacuggaguucuccucaauccacuucaguagauagcuauggcuaggccucauugcauugcacuguuacauaacugugaucauggggccaaaagcuagcuauguauagugaagugcuugggggaacuccaguugacac

SEQ ID NO: 6560 - RNA, 86 nt, Oryza sativa
gagucccuaggaguuccuuucaagcacuuuacgacacacuguauugagaguugucgugaaguguuugggggaacucuuagugucgc

SEQ ID NO: 6561 - RNA, 89 nt, Oryza sativa
guauuaucaagaguucucuuuaagcacuucauacgacaccauuauuuauaggguuguugugaaguguuuggaggaacucucggugucau

SEQ ID NO: 6562 - RNA, 88 nt, Oryza sativa
guauugucgugaguucccuucaagcacuucacguggcacuaucucaaugccuacuaugugaaguguuugggggaacucucgauaucac

SEQ ID NO: 6563 - RNA, 88 nt, Oryza sativa
guauuaucgagaguucccuucaaccacuucacguggcacuguuucaaggccuauugugugaaguguuugggggaacucucgauaucac

SEQ ID NO: 6564 - RNA, 82 nt, Oryza sativa
uuaucgcggguucccuucaaucacuucacaugguacuauuucaaggccuacuaugugaauuguuugggggaacucucgaugu

SEQ ID NO: 6565 - RNA, 86 nt, Oryza sativa
guaucaccgugaguucccuucgaacacuucacguggcacuauuucaaugccuauugugaaguguuugggggaacucucgaugucau

SEQ ID NO: 6566 - RNA, 112 nt, Oryza sativa
uuguuaccuggaguuuccucaacacacuucacaucugcuaggcccuauuacaauugcgcaauguggagucugcaauugguagugaaguguuugggggaacucuagguggcac

SEQ ID NO: 6567 - RNA, 99 nt, Oryza sativa
guuuuaccgggaguucucuucaagcacuucacguagagcuuucuauugacauggagcuuuagaacaaugugaaguguuugggggaacucuugguaccaa

SEQ ID NO: 6568 - RNA, 112 nt, Oryza sativa
guguucccaagaguuccuugcaagcacuucacauagaacuucuguuacucucauguaacauugggaacuugagaagcuacugugaaguguuugggggaacucuagguggcac

SEQ ID NO: 6569 - RNA, 99 nt, Oryza sativa
guuuuaucgggaguuuccuucaagcacuucacguagagcuuucuauugauauggagcuuuggaacaaugugaaguguuugggggaacucuugauaccaa

SEQ ID NO: 6570 - RNA, 94 nt, Oryza sativa
gcguuccuuccaagcacuucacacagagcuuuuauuucucucacaucgauugagaacuuaauuagaagcuuuugugaaguguuugggggaacuc

SEQ ID NO: 6571 - RNA, 120 nt, Oryza sativa
gaguucuccucaaaucacuucaguagauagcuagcuaggcuucauugcauuacacuguuacaaaacugugagcauggggccaaaagcuaguuguauauagugaaguguuugggggaacuc

SEQ ID NO: 6572 - RNA, 66 nt, Oryza sativa
gaguucccuucaagcacuucacgacgcacuauuuagagaguuguugugaaguguuugggggaacuc

SEQ ID NO: 6573 - RNA, 69 nt, Oryza sativa
gaguucucuuuaagcacuucauacgacaccauuauuguuaggguuguuaugaaguguuuggaggaacuc

SEQ ID NO: 6574 - RNA, 68 nt, Oryza sativa
gaguucccuucaagcacuucacguggcacuauuucaaugcguaccgugugaaguguuugggggaacuc

SEQ ID NO: 6575 - RNA, 68 nt, Oryza sativa
gaguucccuucaagcacuucacaugacacuauuucaaugucuauuaugugaaguguuugggggaacuc

SEQ ID NO: 6576 - RNA, 68 nt, Oryza sativa
gaguucccuucaaccacuucacguggcacuauuuuaggaccuacuaugugaaguguuugggggaacuc

SEQ ID NO: 6577 - RNA, 86 nt, Oryza sativa
guaucaccgugaguucccuucaagcacuucacguggcacuauuucaaugccuauugugaaguguuugggggaacucucgauguucc

SEQ ID NO: 6578 - RNA, 143 nt, Oryza sativa
uuauccacuggaguucuccucaaaccacuucagcagauagcuagcuaggccucauugcauugcaccacuguugcauaacuaugagcauggggccaaaaguuagcugcuuauagugaaguguuuggggaaacuccgguuggcaa

SEQ ID NO: 6579 - RNA, 86 nt, Oryza sativa
acacugccaggaauucccuucaagcaauucaugaaacaauauuuugagaguuguugugaagcguuugggggaaaucucagugucgc

SEQ ID NO: 6580 - RNA, 69 nt, Oryza sativa
gaauucucuuuaagcacuucauacgacacaauuauuucaaggguuguugugaaguauuuggcggaacuc

SEQ ID NO: 6581 - RNA, 69 nt, Oryza sativa
gaguucucuuuaaucauuucacauggcacuauuuuaaggccuacugugugaaguguuugggggauucuc

SEQ ID NO: 6582 - RNA, 96 nt, Oryza sativa
auuugguaucgccaugaguucucuucaaacucuucauacgacacuaauucaagugauguugugaaguguuuggaguagcucuuggugucaccaaac

SEQ ID NO: 6583 - RNA, 110 nt, Oryza sativa
uggccccaggaguuccuugcaagcacuucacauagaacuucaguuacucucauacaacauugugauuuugagaagcuauugugaaguguuugggggaacucucggugcca

SEQ ID NO: 6584 - RNA, 154 nt, Oryza sativa
cuuugugaucuuccacagcuuucuugaacugcacgcaugaugaauaaucccuuugguuaauugugaucuggucucugagagaucguaguuagacucgaucgguugcauuggcaucagagagagcaguucaauaaagcugugggaaauugcagag

SEQ ID NO: 6585 - RNA, 116 nt, Oryza sativa
cuuuguggucuuccacagcuuucuugaacugcaucuuugagagagauuagcaucccuauguguggauuuugcuugcacgagugugcaguucaauaaagcugugggaaauuacagag

SEQ ID NO: 6586 - RNA, 141 nt, Oryza sativa
ugccaugccuuuccacagcuuucuugaacuucucuugugccucacucacuuucauuacuggagagauaugcaucaucaguggaagcuuauagggagaggagugcaagaagagggucaagaaagcugugggaagaaauggca

SEQ ID NO: 6587 - RNA, 121 nt, Oryza sativa
uacagcgagugguucuggaaggcgguggaggugacggcggcggccggcgccguggcggggggcugcgaguggggggcgacgagcugcgcuuccacaggcuuucuugaacgguugcggccgc

SEQ ID NO: 6588 - RNA, 184 nt, Oryza sativa
gcgggcaugcuuuccacaggcuuucuugaacugugaacucguggggguguaugugcucauguugggauuguggucgguggccuccaauucucugaaaagaaagcugaauugucgagcuccccguucugucuuuggucgucucuaccuguugaugguucaagaaagcccauggaaaccaugccgc

SEQ ID NO: 6589 - RNA, 176 nt, Oryza sativa
gccaugcucuccacaggcuuucuugaacugugaacucgugugugcaugcuccucauauauuguucuagaucccaugcaugaugcauaucgaucgaucugaucugaauuaggucaucgaugcgcaucuggauccccaucuuguugauaguucaagaaaguccuuggaaaacauggug

SEQ ID NO: 6590 - RNA, 181 nt, Oryza sativa
ggcgacgucgaggcguggaaggagucgagguggagcuggagaggagcgccggcgccggcgccguagcugggcgcgucggcgucgugcggcggcggcgagauggagagcgcggacgggcgguagacggcggcggcggcggggggcggcauuuccacaggcuuucuugaacgguucuugccgc

SEQ ID NO: 6591 - RNA, 141 nt, Oryza sativa
agggcgccggggaggaggugguggugguggugggggcgacgccggcggagguguucgacgcggcggagguggcggaggaggacggcggcggcggcguggccaaggacauuuccacaggcuuucuugaacgguucuugccac

SEQ ID NO: 6592 - RNA, 114 nt, Oryza sativa
aucaaaugcaucauugagugcagcguugaugaacaacgguaaccgguccauguugaugcgcauuuggccggugaucugaucaucaucagcgcuucacucaaucaugcguuuggc

SEQ ID NO: 6593 - RNA, 118 nt, Oryza sativa
agggaaggcauuauugagugcagcguugaugaaccugccggccggcuaaauuaauuagcaagaaagucugaaacuggcucaaagguucaccagcacugcacccaaucacgccuuugcu

SEQ ID NO: 6594 - RNA, 115 nt, Oryza sativa
gcugaacccagaggagugguacugagaacacaggugccaauacaauguauggugagcuacuguauaauggaguaauucuguaacuguguucucaggucaccccuuuggguuucuu

SEQ ID NO: 6595 - RNA, 88 nt, Oryza sativa
ggaguuccuacaggggcgagcugggaacacacggugaugaggcggucuggucuuucguguguucucaggucgccccugccgggacucu

SEQ ID NO: 6596 - RNA, 149 nt, Oryza sativa
cugugaauuacagggcaguucaccuuuggcacaagggcaagcaguagaaaccaugcgugcuugcuagagcuggaaaugaugcugguagcauugcaugguucagggaucacagaucucgugccaaaggagaauugcccugcgauuuuguc

SEQ ID NO: 6597 - RNA, 97 nt, Oryza sativa
gugagaaucacagugcgauucuccucuggcauggcaugagaggccuaaaaaagagacgcacugccgugccaaaggagaauugcccugccauucagaa

SEQ ID NO: 6598 - RNA, 110 nt, Oryza sativa
cggcgaauuacagggcgguuucuccuuuggcacguacggaggcaaggcaugcggugaaaaaucucuagcuagccaugcgugccaaaggagaauugcccugcgauucacca

SEQ ID NO: 6599 - RNA, 286 nt, Oryza sativa
aagacaguaguaggcagcucuccucuggcaggugcauucuaggugauuuuguaauuguauaugcauccaagguauauacaguccggccauggugcuacauugcaaucauccauaugugauugcauuguguauauauauacaugguggccuuugauagaccaucauauaucgguugguuaugugcauguauguauauaccagcugcuacuagcuuugaucgaucgccauguagcgauugaauucaccaaaacggccugccaaaggagaguugcccugcgacugucuu

SEQ ID NO: 6600 - RNA, 118 nt, Oryza sativa
acaugcauuaccgggugagucuuccuuggcaguguucgaaucggcaguaccggucugcaagugaucggucaaucaccaguucaccgcugccaaaggagauuugcccagcaaugcaacu

SEQ ID NO: 6601 - RNA, 117 nt, Oryza sativa
ugguggauuaccgggccaugucuccuugggcagaggugaucagauugcacacuucacuucaaccucuugcucuagcuuguucucucugccaaaggagauuugcccagcaauccacau

SEQ ID NO: 6602 - RNA, 119 nt, Oryza sativa
augugcauugcagggcaacuacuccauuggcagagggauggauuggauauggauauggcugaugcuuccauuugaucccaucccuaucugccaaaggagauuugcccagcgauucacuc

SEQ ID NO: 6603 - RNA, 99 nt, Oryza sativa
ccaugcauuacugggcaggucucccuuggcaguggccgaucgagcugaucaaaccacgcaaaagccacugccaaaggagacuugcccagcaaugcagau

SEQ ID NO: 6604 - RNA, 116 nt, Oryza sativa
gugagaaucacagugcaguucuccucuggcauggagggcaagaggagcugaauagcuaauggaugauaaacugcuagccuuucccugccaaaggagagcugcccugccauucagug

SEQ ID NO: 6605 - RNA, 106 nt, Oryza sativa
aguccaguuucagggcuccucucucuuggcagggagcaugugaagucuuuuguagcucacucauuuucagcccucugccaaaggagaguugcccuaaaacuggacu

SEQ ID NO: 6606 - RNA, 106 nt, Oryza sativa
agcugcauugcugggcaaguuguccuuuggcagauguugcaguucaucaucgaugccuggggguuaccagacuacugccaaaggaaauuugccccggaauucaucu

SEQ ID NO: 6607 - RNA, 213 nt, Oryza sativa
gggaguucugugauuggagaggagaggagacagggaugaggcagagcaugggauggggcuaucaacagauguagauuauuccuugcacaagagaugaugaugagcugugaaugaguucugagagauggcugguguuguuguugcucccuccccugcacugccucuucccuggcuccccugcacaccucucucucucucucucucucucugugu

SEQ ID NO: 6608 - RNA, 113 nt, Oryza sativa
acggcuaguuucacuuguucugcacauguggaaaacaguuagcacucuaucugagucguaaucccaagcauuauuacagaaaaauaaaagugcauuacaaagaagucagacau

SEQ ID NO: 6609 - RNA, 106 nt, Oryza sativa
guugccgcugccgucauccucaucaucaucguccuugcaugaaaccgccagcaaauccuugcgcggggggagggggaaggggagggggaggggucggaggggcggc

SEQ ID NO: 6610 - RNA, 144 nt, Oryza sativa
agagaguuuuacagagcagaaacagaacagaagcagagcagcuguguauacacaacacugcaacuaucccuaucacugagggacaaagcagaaaccagcugagcucuccuuggcugucuguacaagcaaagcaaaagcuucaag

SEQ ID NO: 6611 - RNA, 109 nt, Oryza sativa
gaugaggaguaugaauagaaagaauuagaaaagcuacggugguuguugagcagcgccaaaaaaaacucugcuuugcucuguuucuguguucguccguacacuguucauc

SEQ ID NO: 6612 - RNA, 66 nt, Oryza sativa
uuugguacaaauuugaauucuuaaaucucuuauauuaugauaugaauguagugaauuuguuccaug

SEQ ID NO: 6613 - RNA, 82 nt, Oryza sativa
cguuagcugucugcaaucugccauucuuaucaucgcacauuuaaugugaugaugaaaugacgcauuucugucaagucucacc

SEQ ID NO: 6614 - RNA, 103 nt, Oryza sativa
ucuucucuguucucugugaugaaugcugacgauguuguagaugugaacuuuuuuuuucucuguugucuaugaugaaugcuuguuguccuggagauauuguaga

SEQ ID NO: 6615 - RNA, 148 nt, Oryza sativa
ucgcauuuuuggaaguuuguccuuacgaaaaggcuagcaaaauuuagugaggcaaugaaugaaaagacaucuagcgauacuaaaauuaaaauuugauaacccuaaaaugugucaaacuuuggcauuucgugaaaauccuucaaugcga

SEQ ID NO: 6616 - RNA, 132 nt, Oryza sativa
uuccaccuucccaaaaacuccccagcagaccuggagcgaaaauugccuugaauuagcuucagaccuauagugucguugauaguuuagggacauguuuuauccgguauuggaguugagggaugaaaauuggac

SEQ ID NO: 6617 - RNA, 213 nt, Oryza sativa
cccucuguuucauauuguauuguguuuuaguuuuguuguaagucaaaauucuuuuacuuugaccaaguuuguaguaaaauaauuaacaucuaaaauaccaaauaaauacacuauugagacauauuucuugguugauuuuucuauaaacuuggucaaaguuagagaaguuugacuuaggacaaaacuaaacaccuuaugauauggaacagaggg

SEQ ID NO: 6618 - RNA, 186 nt, Oryza sativa
aacguguuuugggcaaacuuguuuucccacgcguuauagugaaaacuuuuggaauauguuuguuaugggaguauauauuauugauauuggaucuagaagcauaauuuuauauaacguguguuacggguggacaugguuucaaaaguuuucacuuuaacgcgugggauaucaucuacuuccuccguu

SEQ ID NO: 6619 - RNA, 93 nt, Oryza sativa
uacccugucgaacugacgcaguucgacauguaccugucgaacugugguuguucgauagguaucccugucgaaccgcgguuguucgacagggug

SEQ ID NO: 6620 - RNA, 60 nt, Oryza sativa
uuccugucgaauugugguuguucgauagguaccccugucgaaccgcgguuguucgacagg

SEQ ID NO: 6621 - RNA, 93 nt, Oryza sativa; identical to SEQ ID NO: 6619

SEQ ID NO: 6622 - RNA, 98 nt, Oryza sativa
ccaccuacccugucgaacucacguaguucgacauguaccugucgaacugugguuguucgauagguaucccugucgaaccgcgguuguucgauagggug

SEQ ID NO: 6623 - RNA, 98 nt, Oryza sativa
ccaccuacccugucgaacugacgcaguucgacauguaccugucgaacugugguuguucgauagguaucccugucgaaccgcgguuguucgacagggug

SEQ ID NO: 6624 - RNA, 96 nt, Oryza sativa
accuacccugucgaacugacgcaguucgacauguaccugucgaacugugguuguucgauagguaucccugucgaaccgcgguuguucgacagggug

SEQ ID NO: 6625 - RNA, 88 nt, Oryza sativa
uccugucgaacugacgcaguucgacauguaccugucgaacugugguuguucgauagguaucccugucgaaccgcgguuguucgacagg

SEQ ID NO: 6626 - RNA, 99 nt, Oryza sativa
accaccuacccugucgaacucacgcaguucgacauguaccugucgaacugugguuguucgauagguaucccugucgaaccgcgguuguucgacagggug

SEQ ID NO: 6627 - RNA, 125 nt, Oryza sativa
gcagggacauauccaacgggcaguguucgauaggggcguggcuacagugacacuacaauguuuuuuucuauuuuuaaaauuauuuaaucacaugucgaaccgcgguuguucgauagguacccugu

SEQ ID NO: 6628 - RNA, 120 nt, Oryza sativa
auugcuauuguuggugcugggcucguccugaucacuaggagacucugaucaagcuaggccuaaacuuauguauuagugucuccugaugaucgggacaaggcuaacaccgaugagagcgau

SEQ ID NO: 6629 - RNA, 148 nt, Oryza sativa
cgucccauaaaaacaaacccaaaacuagaugugauauaucacaauacaauaaaucuggauaggagucuauccagauacuucuaucuagauuuauuguacugggauaugucacauauauucaguuuuauauuuguuuuuuuuuuggacg

SEQ ID NO: 6630 - RNA, 131 nt, Oryza sativa
augcaauugggggcagcaagcuagagguggcaacugcauaauuugcaagaaauuguuggcugaagaucauaccgaugauauucuugcaaguuaugcaguugcugccucaagcuugcugccuccuguugcca

SEQ ID NO: 6631 - RNA, 138 nt, Oryza sativa
augcaaggggauggugacaagcuuguggcagcaacugcacaucuugcaagaaaaucuuuaggguuuuucagaccauaccgaugauuuucuugcaaguugugcaguuguugucucaagcuugcugccucccuuugccaa

SEQ ID NO: 6632 - RNA, 138 nt, Oryza sativa
aguugcugcaaguggaggcggcaagcuagagacagcaacugcauaucuugcaagaaaaucgguuuuauggccauaccgaugauuuucuugcaagcugugcaguuguugucucaagcuugcugccucccuuugccagaa

SEQ ID NO: 6633 - RNA, 143 nt, Oryza sativa
aguuauugcacaugguggcaccaagcaugaggcaacaacugcauuacuugcaagaaaggcacaaaaucauuagaugauuacuuguggcuuucuugcaaguugugcaguugcugccucaagcuugcugccucccucugccaaau

SEQ ID NO: 6634 - RNA, 140 nt, Oryza sativa
gguuuuguaaccaggggcaauaagcuagaggcaccaacugcauaacuugcgagaaacuuguuggaugaugaucuugccaaugauuuugccgcaaguuaugcaguugcugccucaagcuuacugccuuuguuugcuaaacc

SEQ ID NO: 6635 - RNA, 154 nt, Oryza sativa
augguggcaccaagcaugagguuacaacugcauuacuugcaagggaaucacaagucacaagaaacacauguuauuacaauggauaaucaaugggucaucauacuaugacuuucuugcaaguugugcaguuguugccucaagcuugcugccuccg

SEQ ID NO: 6636 - RNA, 88 nt, Oryza sativa
aguggaaggggcaugcagaggagcaggagauucaguuugaagcuggacuucacuuuugccucucucuccugugcuugccucuuccauu

SEQ ID NO: 6637 - RNA, 99 nt, Oryza sativa
gaagaagagagagaguacagccuuaguucagaucacauaugacuaucuuuugcgagucugaucgauacucugaugaaggcuguacccucucucuucuuc

SEQ ID NO: 6638 - RNA, 138 nt, Oryza sativa
aucgugaaggcuaaauggagaagagagagaguacagcuuugggcgguuuaguuguuagaugguggaaguacuugcgacgccuacuacccuuuucaccaaggcuguacgcucccucuucuucucuuagcuuuuuaugau

SEQ ID NO: 6639 - RNA, 157 nt, Oryza sativa
gugauagagcugcauuugcaccugcaccuacagagaggaagaugaagcagcaagcuagcaauacgugcuugaucgcuauacgcuagcuucuugcacacaauguuguuccuggucucuuccugaucccuaggugcagaggcagaugcaacuaugucau

SEQ ID NO: 6640 - RNA, 81 nt, Oryza sativa
ggcgccgccgagccuugcucgccggggcugcgugccgccauagcuggcgcgcauccccgucgagcguugcucgacggugcc

SEQ ID NO: 6641 - RNA, 69 nt, Oryza sativa
ccgagccuugcucgccggggcugcgugccgccauagcuggugcgcauccccgucgagcguugcucgacg

SEQ ID NO: 6642 - RNA, 81 nt, Oryza sativa; identical to SEQ ID NO: 6640

SEQ ID NO: 6643 - RNA, 94 nt, Oryza sativa
ggcggugacaacgagagagagcacgccggugcggcggucacggugagccggcccgcggcggcguaccugcgugcuuucucccguugucacugcc

SEQ ID NO: 6644 - RNA, 237 nt, Oryza sativa
aauauucacuaugguugccaucauaagcccaccacauguggcucgcaugcuuaaauaacuaacggcauaauuagaucacuugaugacgacguauaucgguguucgcuauauauacuaucuacugguaaguauauauagcgaacaccgauaugcgucaucaucaagugauuuaauuaugccguuaguuaagcaugcgagccacauguggugagcuuacgaugacgaccacaguuuguu

SEQ ID NO: 6645 - RNA, 223 nt, Oryza sativa
agcccaccacauguggcucgcaugcuuaaauaacuaacggcauaauuagaucacuugaugacgacguauaucgguguucgcuauauauacuaucuacugguaaguauaucuuuaauauacuuaccaguagauaguauauauagugaacaccgauaugcgucaucaucaagugauuuaauuaugccguuaguuaagcaugcgagccacauguggugagcuuacg

SEQ ID NO: 6646 - RNA, 234 nt, Oryza sativa
accuccgucccaaaauaagugcaguuuuacacuauucaucuccaaaguuugaucguucgucuuauuugaaaauuuuuuaugauuacuauuuuuauuguuauuacaugauaaaacaugaauaguauuuuaugugugacuaauuuuuuuaaaaauuuucauaaauuuuucaaauaagacggacgguuaaacguuggacacggauuuucacggcugcacuuauuuugaaacggaggu

SEQ ID NO: 6647 - RNA, 170 nt, Oryza sativa
guauccguaucuacguuugaccguucgucuuauuugaaaauuuuaugaaaagauuaaaaaaauagucacgcauaaaguaauauucauguuuuaucaucuaauaacaauaaaaauacuaaucauuaaaaauuuucaaauaagacggacgguuaaacguuggacacgaauac

SEQ ID NO: 6648 - RNA, 164 nt, Oryza sativa
gguuuccgcgucuaauguuugaccguccaucuuauuugaaaaaaauuaaaaacauaagucaugcauaaaauauuauucauguuuuaucauuuaacaauaauaauaacaccaaucauaaaaaaaaauuauauaagacggacgguuaaacguuggacacggaaacc

SEQ ID NO: 6649 - RNA, 153 nt, Oryza sativa
cguauccaacauuugaucaucugccuuauucgaaaaauuuauaaaaaaaaacaagucacgcauaaaguauuauucauguuuuaucauauaagaacaauaaaaauacuaaucauaaaaaaaguaaauaagacggacgguuaaacguuggacacg

SEQ ID NO: 6650 - RNA, 170 nt, Oryza sativa
guuuuagugcccaacuuugaccguccgucuuauuugaaaauuuuuuuauuacuauuuuuauuguuauuagaugauaaaauauaaauauuacuucaugcgugacuuaauuuuuaaaaaaauuucauaaaauuuuuaaauaagacggacgguuaaacguuggacacggaaac

SEQ ID NO: 6651 - RNA, 179 nt, Oryza sativa
caugaguuuugugucuaacuuugaucguccguuuuauuuuaaauuuuuuaugauuaauauuuuuauuguuauuagauuauaaaacacaaauaguacuuuaugugugacuuauguucuuuaguuuuuucaaaaaaaauuaaauaaaacggaugauuaaaguuggacacggaaauucaugg

SEQ ID NO: 6652 - RNA, 242 nt, Oryza sativa
uuccgauguaaucccucuguuccauuuuaagugcagccaugguuuuacgcgcucaacuuuaaucguccgucuuauuuaaaaaaaauuaaaaacauaagucaugaguaaaguauacuauucauauuuuauuaucucauaacaauaaaaauacuaauuauaaaaaaauuuaaauaagacggaugauuaaaguuggacauggaaacucauaguuguacuuaaaaugggacgaagggaguaucauu

SEQ ID NO: 6653 - RNA, 187 nt, Oryza sativa
uuguacucccuccgucccauuuuaagugcaaucaugaguuucgcccaacuuuaaucaucuguuuuauuugaacuuuuuauaaauaguauuuuuauuguuaugagauuauaaaauuuaaauaagacggaugauuaaaguuggacacgaaaacucauggcuacacuuacaaugaaauggagggguacua

SEQ ID NO: 6654 - RNA, 242 nt, Oryza sativa
uagaacucccuccauccaaaaauaagcguagccauaaguuuucgucuucaacuuagaucaucugucuuauuugaaacuuuuuuaugauuaguauuuuuuuauuagauuguaaaacaugaauauuacuuuaugcaugacuuauauuauuuuagauuuucuaaaaaaaauaaauaagacggaugauuaaaguuggacacgaaaacucagggcugcgcuuauuuugggaaugagggaguacggag

SEQ ID NO: 6655 - RNA, 297 nt, Oryza sativa
agagugcauccuuggucuuggauaguacuuccuuugucccaaaauaagcguagccaugaguuuucuuguccaacuuuaauuguucgucuuauuuaauuuuuuuuugaaaaaacuaaaaaacacaagucacgcauaaacuacuauucauguuuuauaaucuaauaacaauaaaaauacuaaucauacaaaaauuucaaauaagacggaugauuaaaguuggacacggaaacucauggcugcguuuauuuugugacggagagaguacuauuggaaagaucagcuaguuggaaaaugcca

SEQ ID NO: 6656 - RNA, 226 nt, Oryza sativa
cuccguuucauaauaagugcagccaugaguuuccgcgcucaauuuugaucguccgucuuauuugaaauuuuuuuauaauuagcauuuuuguuguuaugagaugauaaaacaugaauaguacuuuacuugugacuuauguuuuuaaauuuuuucaaaaaauuuuuaauaagacgaacgguuaaaguuggacgcggaaaaccauggcuacacuuauuuugagacggag

SEQ ID NO: 6657 - RNA, 242 nt, Oryza sativa
aguacuuccuccguccuauuuuaagugcaaccauauauuuucguauucaauuuugaucguucgucuuauuuuaauuuuuuuguaauuaauauuuuuguuguuauaagaugauaaaacaugcauaguauuuuacgcgugacuuauguuuuaaauuuuuucuaaaauuuuuuuaaauaagacgaacgguuaaaguuggacgcggaaaauuauggaugcacuuaaagugggauggagggaguauu

SEQ ID NO: 6658 - RNA, 187 nt, Oryza sativa
agucauacguuuccgcguccaacuuugaucguccgucuuauuugaaauuuuuuuauaauuaguauuuuuguuguuaugagauaauaaaauaugaauaguacuuuacucgugacuuauguuuuuaauuuuuuuuaaaaaaaauucaaauaagacgaacgguuaaaguuggacgcggaaaacuauagcu

SEQ ID NO: 6659 - RNA, 203 nt, Oryza sativa
cuuaagugcagccaugaguuuccgugcccaacuuuaucguucgucuuauuugaaauuuuuuuaugauuaguauuucuauuguuauuagaugauaaaacaugaauaguacuuuaugugugacuuauguuuuuauuguuuuuaaaaaaaauucaaauaacacagacgaucaaaguugggcacggaaaaucauggcugcacuuaaa

SEQ ID NO: 6660 - RNA, 173 nt, Oryza sativa
gguuuucguguucaacguuugacugucuaucuuauaugaaaauuuuuuuauuaguauuuuuauuauuguuagaugauaaaacaugaauaauacuuuaugcaugacuuaucuuuuuaauuuuuuucauaauuuuuuuaaauaaaaugaacggucaaauguuagacacggaaacu

SEQ ID NO: 6661 - RNA, 214 nt, Oryza sativa
ccuauuuuaagugcagccaugauuuuccgugcacaacuuuaaucguccguuuuacuugaauuuuuuuugaaaaaaaugaaaaaguaagucacguauaaaguacuauucauauuuuaucaucccauaacaauaaaaaugcaaauuauaaaaaaaauucaaauaagacggacgauuaaaguugggcaugaaaacuuaugguugcacuuaaaauggg

SEQ ID NO: 6662 - RNA, 242 nt, Oryza sativa
uacuccauccgucucaaaauaagugcaguuuugcacuauucauacuuaacauuugaacguucgucuuauuugaaaauuuuuuaugauuaguauuuuuauugcuauuagauguuaaaacauaaauaguacuuuaugugugacuaaauauuuucaauuuuuucacaaaauuuucaaauaagacggacagucaaacguuggguacgaauaucuacggcugcacuuauuuugggacggagguagua

SEQ ID NO: 6663 - RNA, 218 nt, Oryza sativa
ccuaaaauaaguauaguuuugcacuguucaugucuaacguuugaccguucgucuuauuugaaaauuuuuuaugauuaauauuuuuguuguuauuagauaauaaaacaugaauaguauuuuaugugugacuaacuuuuuuuaauuuucuuauaaauuuuuuaaauaagacggacggucaaacguuagacacgaauuucuacggcugcacuuauuuuagg

SEQ ID NO: 6664 - RNA, 171 nt, Oryza sativa
uggguuuucguguacaacaugaucguucgucuuauuugaaaauuuuaugaaaaaauuaaaaaaaucacacauaaaguacuauucauauuuuaucauccaauaauaauaaaaauacuaaucacaaaagaauuuuuaauaagacggacaaucaaacguuggacacagaaauuc

SEQ ID NO: 6665 - RNA, 222 nt, Oryza sativa
uauguuccauuuuaagugaaaccaugaguuuuuuaccgaacuuugauugucugucuuauuugaaauuuuuuuauaauuaguauuuuuacuguuaugagaugauaaagcaugaauaauacuuuaugcaugacuuaugcuuuuaauuuuuucaaauuuuuuucaaauaagacgaacgaucaaaguuuagcacggaaaaucauggcugcacuuaaaauagaacau

SEQ ID NO: 6666 - RNA, 217 nt, Oryza sativa
uguuuuauuuuaaguguaaccauaaaauuucaugcccaauuuugaucguucaucuuauuuggauuuuuuuauaauuaauauuuuuauuauuaugagauaauaagacaugaauaguuacuuuauuuguaacuuacguuuuuaauuuuuuuaaguuuuuuaaaagacggacggucaaaguugaucacggaaaaucauggcugcacuuaaaaaugggaca

SEQ ID NO: 6667 - RNA, 232 nt, Oryza sativa
acugcauccuccguuccaauuuuagugaaaccauaaguuuccgugcuuaauuuuaacuguuuauuuuauuuaaauuuuuuuuauaauuaguauuuuuguuguuaugagaugauaaaacauaaguauuacuuuaugcgugacuuauguuuuuauuuuuuuucaaauaaaaaggacgauuaaaguuagauauaaaaacucauggcugcacuuaaaaugggacggagagaguacu

SEQ ID NO: 6668 - RNA, 97 nt, Oryza sativa
accuaguaccggacgagacacuucauaguacaacgaaucuggacaguaagccuguccagauucguuguacuaugaagugucauauccgguccuaagu

SEQ ID NO: 6669 - RNA, 74 nt, Oryza sativa
accggacgagacacuucauaguacaacgaaucuggacaugaagauucguuguacuauaaagugucucgucuggu

SEQ ID NO: 6670 - RNA, 83 nt, Oryza sativa
accagaugugacacuucauaguacaacgaaucuggacaggaagcauguccggauucguuauacuauaaaguguccuauucggu

SEQ ID NO: 6671 - RNA, 83 nt, Oryza sativa
uuuuuuuagacucuuaauuucuuuuucuaggaugaacucuuaggguguguuugaggagaaggggauugaggagauuggggaga

SEQ ID NO: 6672 - RNA, 130 nt, Oryza sativa
cuaaugguucaccucguuuugcguauauucccaaucuucucuauuuccuucuccucaaacacagccugggaguguuugagaaggggauugaggagauugggaagauacguaaaacgaggugagccauuag

SEQ ID NO: 6673 - RNA, 103 nt, Oryza sativa
cuucuccucucuucucuccuccaccucagcauuuagccggcuuauagccuauacuuccucuaaggguguguuugaggagaaggggauugaggagauugggaag

SEQ ID NO: 6674 - RNA, 77 nt, Oryza sativa
augugacauauuuuacuacaacgaaucuggauaugacagagguauguuuaaauucguaguauuaggaugugucacau

SEQ ID NO: 6675 - RNA, 83 nt, Oryza sativa
uaucucaaucaggccucaaguugguguccgucauggaugauggucauccgugacgggcuccaacuugaggcccgauugagaua

SEQ ID NO: 6676 - RNA, 144 nt, Oryza sativa
ucccuccaucccauaguauaagggauuugggaaugaugugacauauccuaguauaaugaaucuggacaaaccgucuguccaaauucauuguccuaguaugugucacaucuacucaaaaucccuuauauuaugggacggaaggga

SEQ ID NO: 6677 - RNA, 113 nt, Oryza sativa
ccuccgucccauaauauaagagauuuuagauggaugugauacaucucaguacaaugaaucuguacuauaauauaucauauccauccaaaaucccuuauauuaugggacggagg

SEQ ID NO: 6678 - RNA, 176 nt, Oryza sativa
auaauauacucauuucguccuauaauauaagggauuuugaagggaugugacacauccuagcuauaaccauauaucuagacauagcuaggaacauauaucuagacaugcucuugucuagauauauguguuauaucucuccaaaaucccuuauauuaugggacggaugaauauguuau

SEQ ID NO: 6679 - RNA, 139 nt, Oryza sativa
uuccuauuaauuguuacucucuccaucccauaauauaagggauuuuagagggaugugaucuagauucguaguccgaggaaacaucacauaccucuaaaaucccuuauauuaugggacggagggaguacuaguuuaggaa

SEQ ID NO: 6680 - RNA, 225 nt, Oryza sativa
ccccguccuauaauauaagggauuuugaguuuuugcuugcacuguuugaccacucgucuuauuuaaauuuuuuuuggaauuauuauuauuuuugacuuauuuuauuauccaaaguacuuuaagcauaacuuuucguuuuuuauauuuguacaaauuuuuugaauaaaacgaguggucaaacaauacaaacaaaaacuuaaaaucccuuauauuaugggacggagg

SEQ ID NO: 6681 - RNA, 279 nt, Oryza sativa
gugggggcaucccucacuguuuucugguaaagaaaaauauaauggauuuugacuuuuucuugcacuguuagaccacucgucuuauuaaaaaaauuuggaauuauuauuuauuuuauuugugacuuacuuuauuauccaaaguacuuuaagcacaacuuuucauuuuuuaauauuuggacaauuuuuuuuaaauaagacgagugguuaaacagugcaaagcaaaaaaucaaaaucccuuauauuacgggauggagggagcauguaggauggccaugccau

SEQ ID NO: 6682 - RNA, 191 nt, Oryza sativa
ugcgucggccucguggauggaccaggagcucaacauuccuuaagguuguucuuucaaacccauacaagguuccaccgccugcauuguuccaagagugucuuggaugaaaguaggaaguggaaccuuguuaggguuggaacgaacugccuuaaggaagucgaugcuccagguccguccaggaggacgacuca

SEQ ID NO: 6683 - RNA, 201 nt, Oryza sativa
guacaugcgucggccucguggauggaccaggagcucgacguuccuuaaggccguucuuuccgacccauacaagguuccgucgccugcauuguuccaagagugucuuggacgaaagcaggaaguggaaccuuguuaaggucggaacgaacugccuuaaggaagucgaugcuuuagguccguccacgaggacgacgcagcuag

SEQ ID NO: 6684 - RNA, 191 nt, Oryza sativa
ugcgucggccucguggauggaccaggagcucgacauuccuuaaggucguucuuuccgacccauacaagguuccgcugccugcauuguuccaagagugucuuggacaaaagcaggaaguggaaccuuguuaaggucggaacgaacugccuuaaggaagucgaugcuccagguccguccacgaggacgacgca

SEQ ID NO: 6685 - RNA, 274 nt, Oryza sativa
gauaucagcugaaaaagucaucaacaaaaaaguugaauaacucaucaagaucuaaaacuuuuauuuuggucauuucuucauacgacaaagugauaguaacauuguucacagaauugacauaucucuuaucugguuuuauaaacuauaacacauauauguaaaauuugugaauaauauuacuaacauuucgucagaugaagaaauaaaaaaauaaaaguuauagaucuugaugaguuauucaacuuuguuguugaugacuuuuucaauugaaauc

SEQ ID NO: 6686 - RNA, 287 nt, Oryza sativa
cuaaaugauuucaauugaaaaagucaucaacaaaaaaguugaauaacuuaucaagaucuaaaacuuuuauuuuuguuauuucuucauccgacgaaauguuaguaauauuauucacaaauuuuacauauauguguuaaaguuuauaaaaccagauaagagauaugacaauuuuauaaauaauguuaccaucacuuugucguaugaagaaauaaccacaauaaaaguuuuagaucuugaagaguuauucaacuuuguuguugaugacuuuuucaguugauaucauuuag

SEQ ID NO: 6687 - RNA, 266 nt, Oryza sativa
ucaacugaaaaagucaucaacaaaaaaguugaauaacucaucaacaucuaaaacuuuuauuuugguuauuucuucauacgacaaagugauaguaacauuauucacaaaauugacauaacucuuaucugguuuuauaaacuauaacacauauauguaaaauuugugaauaauuuucuaacauuuugucagaugaagaaacaacaaaaauaaaaguuuuagaucuugaugaguuauucaacuuuguuguugaugacuuuuucaauuga

SEQ ID NO: 6688 - RNA, 117 nt, Oryza sativa
uuuuguugcuggucaucuagcuacccgugcaugccuggagauuggagaauaauugacgaugcagcagucggcuuauuggcucuugggcacgcgugguuagaugaccaucagcaaaca

SEQ ID NO: 6689 - RNA, 121 nt, Oryza sativa
uaugggugucgguuuuuaagaaaaaaccggcaucuguaauauauuauaggugucgguuaauuaaaaaccgagaccuauaauauauuauaagugccgguuuuuuuaaaaccgacaccuaucu

SEQ ID NO: 6690 - RNA, 119 nt, Oryza sativa
auaggugccgguuuuuuaaaaaaacccgacaccuuuaauauauuauaggugucgguaaauuaaaaaucggcaccuauaauaaauuauaggugucgguuuuuuuaaaaaccggcaccugu

SEQ ID NO: 6691 - RNA, 96 nt, Oryza sativa
uuaggccuacuuuggaacggaggaauuuuauaggauuuuugcgggaauuuuaacagauuccuguaaaauucauucguuccaauguagcccuauuag

SEQ ID NO: 6692 - RNA, 136 nt, Oryza sativa
gcacaacacuaguauuugggaggcaacuacacguugggcgcucgauccaggggugggaaaaucgggcgcccacguuuuccccacccccggaucgagcgcccaagcgguaguugucucccaaauacuugugcugugc

SEQ ID NO: 6693 - RNA, 300 nt, Oryza sativa
ccagcuaguuuagcucccaggccagucaagguagaggcagcucaaaguguagucaucucuugaucguugauugcuccaguccuaucccaugcuccuccuugagcucccaaucauugagcucucggauccucucugcucuucucugaucuggugucguuccaguuuccaaacauguugcagaaugaagaacacugaacaacaagauuauaagguagguaaguaguugaucauuucagguuuccagagaugauaaagcaaucagggaugcaugcacacugaugcugauuguacaaacuccaa

SEQ ID NO: 6694 - RNA, 102 nt, Oryza sativa
cuguugacugcauuaggauucaauccuugcugcuaaauguauugcuuauauucagcaauauaauguucagcagcaagaacuggaucuuaauauagucgauag

SEQ ID NO: 6695 - RNA, 130 nt, Oryza sativa
aaauagaaucuugaugaugauuaaaaggagggacgauaggcaggccgugaagcaaauauguaagacgguugccgggaauucuagaaagugaaaaaaaaaccccauugauaaucauauucgauuuucaaaa

SEQ ID NO: 6696 - RNA, 257 nt, Oryza sativa
uggcugcgcgcgaccgcgccgucccgcaggccagcgccgcgccaccgcgcgguuccgcagcagggacaugcgccacccguuacagccaacugaaaucugcacugauuugauuacaugcgcacguauauaugcagugcaugcagcgagugugcgcuguuccuggauucggucgcgcguggccgugcugcggaaccgugcgguggcgcggcgccggccugcgggaccgcgcagucgcgcgcagccaagccacgggaccg

SEQ ID NO: 6697 - RNA, 120 nt, Oryza sativa
gguuagugcguuuugcaaauucgcaggcccuaucuugugguaugaacugaguacgcgaugauuuauccugcguauugggggcuuaccauaagauaaagccgugaauuugcaaaacguuca

SEQ ID NO: 6698 - RNA, 124 nt, Oryza sativa
gguuagugcgcuuugcgaauucacgggucuuaucuugugguaugaacugaguacguaaugauuuauggugcauauugggggcuuaccauaagauaaugccaugaauucgcaaagcguucaaacc

SEQ ID NO: 6699 - RNA, 142 nt, Oryza sativa
gcuucaguagguuagugcacuuugcgaauucgcaggcccuauccugugguaugaacugaguacgcgauaauuuauggugcauauuaggggcuuaccauaagauaaugccaugaauucgcaaaguguucaaacccacugaagu

SEQ ID NO: 6700 - RNA, 124 nt, Oryza sativa
gguuaguguacuuugcgaauucacaggcccuauauugugguaugaacugaguacgcgaugauuuauggugcauauugggggcuuaccauaagauaaugccaugaauucgcaaaguguucaaacc

SEQ ID NO: 6701 - RNA, 110 nt, Oryza sativa
gcgcuuggcgaauucacaggcccuaucuugugguaugaacuggguacgcgaugauuugcacugcguauugggggcuuaccauaagauaaugccaugaauuugucaagcgu

SEQ ID NO: 6702 - RNA, 109 nt, Oryza sativa
ugcuuugcgaauucacaggcccuaucuugugguaugaacuaaguacgcgaugauuucugguacguauugggggcuuaccauaagauaaugccgugaauucguaaagcgu

SEQ ID NO: 6703 - RNA, 109 nt, Oryza sativa
cgcuuugcgaauucacaggcccuaucuugugguaugaacugaguacgcgaugauuuauggcgcauauugggggcuuaccaaaagauaaugcugugaauuugcaaagcgc

SEQ ID NO: 6704 - RNA, 120 nt, Oryza sativa
guaauauacuaauccgugcauccaucguauaucuuacacgucaugugaacgugcaucgguucauaauguuguguuuauaaauguuaaugguaugugugguugcacggguuuguauguugc

SEQ ID NO: 6705 - RNA, 142 nt, Oryza sativa
augaggagauugccucuguuagccaagaauggcuugccuaucuccacuauuugguucaucacuggaacacacuugggguucucagaugguggaugaaauauggaagauggugagccuuccuggcuaagagagugauucucau

SEQ ID NO: 6706 - RNA, 240 nt, Oryza sativa
gggauucagaaaggaaagacuuaggguugcaagcgggucaacccgugaacccgcuuauaggcaaaauuaguagguaacccguauaaaugaguuuauggaucgacccacuugcaucucuaagugcggcaaaucggaccacgacgugaaaacacacggguuaucacuuauuuuacauauaaguagguuugcgaguuggcccgcuugcaucccuagaugccgucuuagcucuuaacaagcaug

SEQ ID NO: 6707 - RNA, 109 nt, Oryza sativa
ccugugaucaggagagaugacaccgacaucgccggaauucguucuuggucuugugccaugaugaauugaugguccguuugaugcaggugucaucuccccugaacauagg

SEQ ID NO: 6708 - RNA, 183 nt, Oryza sativa
acuuuucuuaagucaaacuuuuuuuuagauuugaucaaauuuauaaaaaaaauauagcaauauuuuuagaaaaaaauauguucaauauuaaauguaaugaaacuaauuuggugcuauaacuguuuuuauauuuuucuauaauaaauuugauuaaacuuugaaguaguuugacuuaaaaaaagu

SEQ ID NO: 6709 - RNA, 161 nt, Oryza sativa
aguuuaugugcuacucccuccgucccauaauauuaaaaccuaggacuggauaggacguuucauaguacaaugacucagagucauuguacuaugaaacguccuauccaguccuagguuuuaacauuaugggacggagggaguagucucaaccuauauaaacu

SEQ ID NO: 6710 - RNA, 188 nt, Oryza sativa
gcgcgcggggagggagggaacggugccuagugcggcaccggagcucgccagcacgcaggagugaggugaggaggacggcggccagggcgcggagagcuugccggcgcuccgccaccgccgcuaccuccuuccgcgugcuggcgagcuccggcgccgcacuaggcacuguuuccucccuccccacgcgc

SEQ ID NO: 6711 - RNA, 268 nt, Oryza sativa
cggaggaaggaggccggcgcacagaggacgagaggugacggcgcguggggagggaggaaacagugccuagugcggcgccggagcucgccagcacgcggaaggagguagcggcgguggcggagcgccggcaagcucuccgcgcccuggccgccguccuccucaccucacuccugcgugcuggcgagcuccggugccgcacuaggcaccguucccucccuccccgcgcgccaucaccgcucguccucugugcgccggccuccuuccuccg

SEQ ID NO: 6712 - RNA, 187 nt, Oryza sativa
guugugauauaagguuuuaggguaauuuuaucauuuuuaagaaaacaaaauuuaauaccuucagauauucgguaucuauguaaaaaauuuuuagaucccucaauaaaauuuaauaccuaaaaucuaaacguauuaaauuuuguuuucuuaaaaauuauaaaauuacccuaauacauaauaccucaau

SEQ ID NO: 6713 - RNA, 172 nt, Oryza sativa
uauuguuuuguuauaaauguaauacuaccuccgucccaaaauauagccauuuuuagcuaugaaucuagacauuguuuuuagcuaugaaucuagacauacaauguccaaauucauaacuaaaaaugcuuauauuuuggaacggagugaguauuaaauuuguaguuuugugaua

SEQ ID NO: 6714 - RNA, 189 nt, Oryza sativa
aaaugccaaugcucaaauaccacucuccuaaauuuccauucccaaauaccacccgggcccacaugucagccucauccagcacagggucccacaucacuuuuguuugaauggaaagugaggcugacaugugggcccggaugguauuugguaaugaaaauuugggagagugguauuugagcacuggcauuu

SEQ ID NO: 6715 - RNA, 188 nt, Oryza sativa
aaaugccagugcucaaauaccacucucccaaauuuucauuaccaaauaccauccgggcccacaugucagccucacuuuccauucaaacaaaagugaugugggacccugugcuggaugaggcugacaugugggcccgggugguauuugggaauggaaauuuaggagagugguauuugagcauuggcauu

SEQ ID NO: 6716 - RNA, 180 nt, Oryza sativa
guuuuuucauucguguccgaaaacuccuuuugauaucuggucaaacauucgaugugacaucuaaaaauuuucuuuucgcgaacuaagggccuguuuaguucgcgaaaagaaaauuuuugggugucacaucggacguuuaaccggaugucggaaaagguuuucagacacgaauaaaaaaac

SEQ ID NO: 6717 - RNA, 185 nt, Oryza sativa
ucuauauucauaguacuagaugugucacauccaguacuagguugguguuuuaugggacgaagggaguagaucuuuugcuaaguggaggcuaaauucucaucaucagaggaguauacuacuccauccgucccauaauauaagggauaauggguggaugcgacacauccuaguaaaaugaaucugga

SEQ ID NO: 6718 - RNA, 112 nt, Oryza sativa
ccgcucccuaccaaugagccgccggaucucccagugaggaggccggggccgcuggauccggugaccccguucuccucgccggcggauccggcgcuccagagaaaggaacgag

SEQ ID NO: 6719 - RNA, 112 nt, Oryza sativa
ccgcucccuaccaaugagccgccggaucucccagugaggaggccggggccgcuggauccagugaccccguucuccucgccggcggauccggagcuccagagaaaggaacgag

SEQ ID NO: 6720 - RNA, 86 nt, Oryza sativa
augagccgccggaucucccagugaggaggccggggccgcugaauccggugaccccggucugcucgcuggcggauccggcgcaaaga

SEQ ID NO: 6721 - RNA, 116 nt, Oryza sativa
ugccugucccucccaccgagcagccggaucucccagugaguaggcccgggccgccagauccggugaccccggucuccucgccgguguauccggcgccgcagggagggacgagagcc

SEQ ID NO: 6722 - RNA, 69 nt, Oryza sativa
cgcauccgccaacgaggaggccgggaccaccggauccggugacuccggccuccucgccggcagauccgg

SEQ ID NO: 6723 - RNA, 110 nt, Oryza sativa
agacucccuaacuuugugcaguuugcaguuguggcacugacauaugggccagacacauuuggcccacauguuagugccacaacugcaaacuacauaaagucaggggaucu

SEQ ID NO: 6724 - RNA, 63 nt, Oryza sativa
ccgcgggcccccucgccggcgcgcgcgugcaggugugcgcgcggccgucgaguggcuccuagg

SEQ ID NO: 6725 - RNA, 90 nt, Oryza sativa
aaauaagcuaaccuaggauaugaugggacauuaccuaucuagauucguuguacuagguaaugcccuaucguauccuagguugguuuauuu

SEQ ID NO: 6726 - RNA, 133 nt, Oryza sativa
augugauggagaugcgauggaaaguugggagauugggggaaguugugugugaacuaaacguggauuggggcccuguuuaguucacaucaaucuuccuccaaauucccaacuuuucaucacaucacaaucacau

SEQ ID NO: 6727 - RNA, 471 nt, Oryza sativa
cagagugucuucgccaaaaugccaucccgaacagaaaugccacuuccucuucuuccuccauccugcgcgugaagagcucgccugcggccauggcuagcucccucccugccaucgccgccgcacgggcagcggagcccgcggcgcaguggcgacucuucgguugacggcggcuggcuacgcgguggcaacgaggaggcggcggcggccaggagcugcuccaccggccccacgcgcacgcgcgccggcgggauccgcgcgucgucgccggaguccuuccgcgacgaccucagcugcacaggcguuggcggggauggcagggagggcagcgccccgaucgccgucggcaaggcggcaucggcgcggcgguggagauggccauggccgccggcgagcucuucacgcgcgggacggaggaagaagaagagccaggggcauuuccgucugggauggcauuuuggcgaagacaccugg

SEQ ID NO: 6728 - RNA, 135 nt, Oryza sativa
uagacuaacuaccccugcauucagaauucauauagcgauugaaaauugaacuccgugcacgguaguaguaguagucagaucuauuguuucuaaucaauugcuauauggauucagaaugcagguguaguuuguuca

SEQ ID NO: 6729 - RNA, 89 nt, Oryza sativa
cgcaacuucgagcauucaaacauucccaauuaccaucgccucccuaaacagcaaugguaauuggggauguucgguugcucgagguugcg

SEQ ID NO: 6730 - RNA, 108 nt, Oryza sativa
cguuuuaaauggugaaauuuguagauuggaggguaacccuagaaccccauuuuugcccaaauuugugauuuucaacauccaauuuggggauuugcugauuauagugcu

SEQ ID NO: 6731 - RNA, 110 nt, Oryza sativa
ccuccccauuucuuggccuccucucgcugcuccugcuugugcucugagccccaacugcucaugcucgugcucaaggaggagcacuggaguagccaagagauggagugcga

SEQ ID NO: 6732 - RNA, 149 nt, Oryza sativa
agagcacugcuaugcguaagacggauucguacuaccugcguccgaccauaucaugugcaccgaucaccgucuuuagcuucucuccaccaaugcaagcagcauucggaugcaugucguacgaauccgucggacgcauagcuauuuucuuu

SEQ ID NO: 6733 - RNA, 130 nt, Oryza sativa
guuuuuauccugguuuuuuuggagcaugagguuaucucucaguuuuuccguguccaaaauaaaaggacaaaaacuguucuugaaaaccgagagauaaccucaugcuccaagaaaaccaggauaaaaaauu

SEQ ID NO: 6734 - RNA, 200 nt, Oryza sativa
ucccgucaucgcugccggcaaagggagggggggugccgcaacaaggagaggaggacggaguggggcgaguggagcgucaaaggggaugucaucgccgccgaaucugcucgugggacauccccuucgaugcuccacucgccccaauccguccuccucuccuuguugcggcaccccccuucgcuggcagcgacgacggccuc

SEQ ID NO: 6735 - RNA, 194 nt, Oryza sativa
ucccgucaucgcugccggcaaaggggggggugccgcaacaaggagaggaggacggaguggggcaaguggagcgucaaaggggaugucaucgcugccgaaucugcuagugggacauccccuucgaugcuccacucgccccaauauguccuccucuccuuguugcggcaccccccuucgcuggcagcgacgauggc

SEQ ID NO: 6736 - RNA, 97 nt, Oryza sativa
gggaguuguaggaauggaugcguagagaaagaaaugaaaucugaaccagauuugugauuugauucuuuccuaugacguccauuccaaugauuuccag

SEQ ID NO: 6737 - RNA, 148 nt, Oryza sativa
ucuugauuugaugguaggguuaguguuauuuguaaagagaaaaccagcuuccagaucucgaauuugccucaaacuuaucuucucuuguagaucuggaagcuagguuuucucuuuacaaauaacacuauuuuuucccccauuaggucug

SEQ ID NO: 6738 - RNA, 129 nt, Oryza sativa
uuguguugcauauucuuaggccugaucuugaggcagaaacugaguaguuggugaacucgcucuauguuguucguucacucgcgacacgguuccugucccaagaucgagucuaugaauauacaaauguga

SEQ ID NO: 6739 - RNA, 118 nt, Oryza sativa
uugcauauucuuaggcccgaucuugaggcaggaacugaguaguucgugaacucgcucuauguuguucguucacccacuauucgguuccugucccaagaucgagucugugaauauacaa

SEQ ID NO: 6740 - RNA, 107 nt, Oryza sativa
cgguguugcauauucuuagacccgaucuuguagcaagaacugaguaguucguuaacucgcuacgcgguucuugucacaagaccgagccugugaauaugcaaaggugg

SEQ ID NO: 6741 - RNA, 118 nt, Oryza sativa
uugcauauucuuaggccuggucuugaggcaggaacugaguaguuggugaacucgcucuauguuguucguucacucgcgacgcgguuccugucccaagaccgagucugugaauauacaa

SEQ ID NO: 6742 - RNA, 92 nt, Oryza sativa
gcauauucuuaggcccggucuuguggcaagaacugaguaguucguuaacucgcuacgcgguucuugucacaagaccgagucugugaauaugc

SEQ ID NO: 6743 - RNA, 116 nt, Oryza sativa
ugcguauucuuaggcccgaucuugaggcaggaacugaguaguuguugaacuugcucuauguuguucguucacccacuauucgguuccugucccaagaucgagucuaugaauauaca

SEQ ID NO: 6744 - RNA, 107 nt, Oryza sativa
cgguguugcauauucuuaggcccagucuuguggcaagaacugaguaguucguuaacucgcuacgugguucuugucacaagaucgagccugugaauaugcaaaguugg

SEQ ID NO: 6745 - RNA, 104 nt, Oryza sativa
uucuuaggcccggucuugaggcaggaacugaguaguuggugaacucgcucuauguuguucguucacucgcgacacgguuccugucccaagacugagucugugaa

SEQ ID NO: 6746 - RNA, 92 nt, Oryza sativa
ggcccgaucuugaggcaggaacugaguaguuggugaacucgcucuauguuguucguucacuugcuacacgguuccugucccaagaucgaguc

SEQ ID NO: 6747 - RNA, 110 nt, Oryza sativa
auauucuuaggcccggucuugaggcaggaacugaguaguuggugaacucgcucuauguuguucguucacucgcgacacaguuccugucccaaggcuaagucugugaauau

SEQ ID NO: 6748 - RNA, 92 nt, Oryza sativa; identical to SEQ ID NO: 6742

SEQ ID NO: 6749 - RNA, 129 nt, Oryza sativa
ucguguugcauauucuuaggcccgaucuugaggcaggaacugaguaguuggugaacucgcucuauguuguucauucacucgcgacacgguuccugucccaagaucgggucugugaauauacaaauguga

SEQ ID NO: 6750 - RNA, 96 nt, Oryza sativa
uugcauauucuuaggcccggucuuguggcaagaacugaguaguucguuaacucguuacccgguucuugucacaagaccgaguauaugaauaugcaa

SEQ ID NO: 6751 - RNA, 129 nt, Oryza sativa
gcguguuguauauucuuaggcccgaucuuguggcaggagcugaguagcuggugaacucgcuuuauguuguucauucacucgcuacacgguuccugucccaagaucgagucugugaauaugcaaauguga

SEQ ID NO: 6752 - RNA, 129 nt, Oryza sativa; identical to SEQ ID NO: 6738

SEQ ID NO: 6753 - RNA, 88 nt, Oryza sativa
guacucccuccgucccgaaauaaccaaaccucguaggacaugucacauccuaguacgagguugguuuauuuugggacggagggaguau

SEQ ID NO: 6754 - RNA, 199 nt, Oryza sativa
ggucauuuagauagaacauguuucaucucagugcgccuacucccuuagucccaaaauaaauuaaucuuauacaagauuuggcacaucauaguacuacgaaucuggauauacuaggaugugucacauuccguacgagguugguuuauuuugggacggagggagggaguaucucggaugccuaccgcaguaucucaugacc

SEQ ID NO: 6755 - RNA, 89 nt, Oryza sativa
acucccuccgucccaaaauaagucaaucccguacuaguauaugacacuuccuaguacgagguugguuuauuuugggacggagagaguag

SEQ ID NO: 6756 - RNA, 150 nt, Oryza sativa
cuacuggcuagucucguagcuugcuagguacucccucugucccaaaauaaacaaagcuaguacggggauguggcacuuccuaguccuguacuagguuuguuuauuuugggacggagggaguaucauaguuuguuacuccucugguuacua

SEQ ID NO: 6757 - RNA, 93 nt, Oryza sativa
uauuuccuucaucccaaaaugaaaaaaucuaguacauuauguguuugacauauccuguacuagauuuguuuauuuugggacggagggaguauc

SEQ ID NO: 6758 - RNA, 79 nt, Oryza sativa
cuuaaaauaaaccagccucguaaagaauggaguacauucuagcacuacuagcauguauaugagguugguuuauuuugga

SEQ ID NO: 6759 - RNA, 123 nt, Oryza sativa
ccaaaauaaacaaacaucgugauaggaugugacacaucauaguaacgagucugaacacguagaauauccagauucguuguauuaggaugugucacaauuuaguaugagguugguuuauuuugg

SEQ ID NO: 6760 - RNA, 374 nt, Oryza sativa
ccauaucucuagucuaauaugguauccgagcuuauugguuaguugcucuuguucccucaaucccguuugucuccauccacaaccacacgagugcaaagccucacauucaugucaacaacaacucucaugucauuagcaaaucuagugucuagcaucaacaccuagguagcacuuauugguuaaaaagggcauuugcuaggaaaaaugagcaaccacuaguccacuacacguuuggaugcuugacaauaugugcgcuuuggugcuugcaauaauaauguugugauggaagguuugucacuaaauauugguuagcaaaguugcaguauggggaagaccaauaagcucugauaccauguuagauuagugauaugccu

SEQ ID NO: 6761 - RNA, 360 nt, Oryza sativa
caauagcaaugcaucaguuacguuuccuacauaguuacaugguaucagagcugaaauccuaaaccaaugaauguuuauccagcaccaauccccugcugcuaggagcuguagcucucggggcaguaccuaauccgcugcugaucuguuucuagucaugaaaagcacugugaucuguaagugcuugcugcaugccaugguuuugcccaauucuauggccaucguuggauucgugaccugacagugaugcaauaaucagugauggauuuguguuggcucuacuugggguugaggaucuuagcuguuagcucugauaccauguuaacuguuuagagacuuggcugaugcauuacuuuuggaaac

SEQ ID NO: 6762 - RNA, 291 nt, Oryza sativa
agcaaugcaucaguuauguuuccuggaucauuaaaucauugaauguuuaucuagcaccaaucugcugcugaucuguuuguagucaugaaaagcacuuuaugaucugaaagugcuggcuguaugccaugguuuuccccauucuaugguuauuauugcaaucgugacuuaauagugaugcaauaaucaguaguggauucguguuggcucuacuucggguuuaggaucauaguuauuagcucugauaccauguuauugauuuagaaacuuggcugaugcauuacuuuuggagac

SEQ ID NO: 6763 - RNA, 256 nt, Oryza sativa
acuacacauugaccaucgcguuacuacgccauucuugagagacgagaauugaaaagaggugggcguggggggagguagcaggcggguuugaccggugggagggggcuuugaccguucuuugaccgaagugggagguggguuuugggcccuagggagggggagguggguuggcccaugagagaccuccccccacacccaccccuuuuugguuugugucgcaggaacauuguaguaacgugauggucaauguguagua

SEQ ID NO: 6764 - RNA, 144 nt, Oryza sativa
cucgaacuacugcuagugauggugauucuucgacacaguauucggcgaguuuugggcuucaucaugcggugcucgacauggugacgaagccugaacuugccaaagacugucgaagaaucgcagucacuaguuguaauuugacuc

SEQ ID NO: 6765 - RNA, 85 nt, Oryza sativa
cuuuugcacggagggauuuugcgggaauuucacgggaauugaguugauuccugaaauuccuguaaaauucuuguguuccaaagga

SEQ ID NO: 6766 - RNA, 169 nt, Oryza sativa
ggaaaggcuuuguaaaacacacuauuugacaguuuggaaagcgugcucacggaaaacgagggagcagccaaggcauuguucuuaccgguuuaugaauuggcuacuuccucguuuuccguaaacacgcuucccgagcuucuaaacgguguguuucuugcaaaaacuuuau

SEQ ID NO: 6767 - RNA, 138 nt, Oryza sativa
aaggaacaccugagaacaauaggcaugggagguauugggaaaacacaggaacauauugugaccccuaauuuuaaagggaaauaaugguugaggcuuuccuccauguucccaugccuaaugcucuuaggugcucuuuuu

SEQ ID NO: 6768 - RNA, 209 nt, Oryza sativa
uagugucaaaguaauggaggauuugggaaauaaacugcguucaugcugaauuagaccuagugggcauuuauacaucacaacacaugguacuguugcccuuuccuuuuucuagccuuaguguugugaucuauauaugcccuuuagggcuaauucagcaugaacauaguuuauucuccauuccucaaaucauccauuacuuuugacacuua

SEQ ID NO: 6769 - RNA, 135 nt, Oryza sativa
uaacaaugaauauaucuguuguuucucucaaaucuaacaugguaucggauccauagguguagccauaucaaucuuaaagcuauggcucugauaucauguugguuuugaaggaaaugacugauauauuucauugua

SEQ ID NO: 6770 - RNA, 78 nt, Oryza sativa
uaauaucucaaugcuuguggagacuuaugguugaacuguugaacuguaagucugugacggguaaacgagcauguaccc

SEQ ID NO: 6771 - RNA, 197 nt, Oryza sativa
uagauuaugaaccucaacaugguaucagagcuggaaguccuaaaguugacaucaugauagccugacgaugguggagaccaugauaagcugauaccauguauuuugccgacauuguguuucuccaagauugugcuacaucacaaacuuagaaaaacuuagaacuucuagcucugauaccauguugaguuuuauggccu

SEQ ID NO: 6772 - RNA, 151 nt, Oryza sativa
ccauaaucaucuauuaguacaguggugaagacauagggcuacuacaccauccauaaggguucgaaucuucgaugugccuagauaggguacaguuggaucccauauggauggagguguaacccgaugccuuuuacaaauagaugguuauuuu

SEQ ID NO: 6773 - RNA, 252 nt, Oryza sativa
gcuguccauuuucauugcacuuugcuccauugugguauugacauucugcaagaacgagucccaguaucaagucacuguuacgguguuguugguaccauugauuaacauaacacuugacggccauacuuggucauguuguauguuaucagcuucacagagguacauguggcacuuuaacaguuauuugauacagugacuaggcugcaguugagcgaaaccacaauggagugaagugcaacagaaaugaacauu

SEQ ID NO: 6774 - RNA, 157 nt, Oryza sativa
ggcacauauguugguauucuauuggaaugcaagugggcuggcuuuugaacccauuuaugggcuauucaaguggguaaaccauagguuggugcacuuaaauggccuauaaguggguuugugggcuggcccucuuguauccugauaguuuaguaugauu

SEQ ID NO: 6775 - RNA, 261 nt, Oryza sativa
auucuaaacucucgaggggacauucucucauugcuugcaugucauccaaauguuuaugaaaaaauuaaaaaaaaucaacuggauagauuaauaugugauagauaacuucauaaacaugcaaguuaaaauuaaacuucuacaaguugcaaaaaacuacaacuaaucuaucacauauuaaucuauuuuauuauuuuuuuaaaaaaaauauaaccauuuagaugacaugugaaugaugaggggauguccucuagagcuuagaau

SEQ ID NO: 6776 - RNA, 100 nt, Oryza sativa
accacugcagacuuaaucuggacacuauaaaagaaaauugugcaugugaaaauaugcccauuauaaauuuguaguguucagauugaguuuagaaugguug

SEQ ID NO: 6777 - RNA, 150 nt, Oryza sativa
uccaacccaucccaccucguccccaaaccaaacacaugcacgcaaauggcuuguugaggaauaaacaucuugcucccuugcauucuaaacuaugauauucuucaagcauauguguuugguuuagggaugaggugggauggguuaggucca

SEQ ID NO: 6778 - RNA, 129 nt, Oryza sativa
guuccgcuugugaaaaucgauuuuuccaagcgggccacuuaagcauuccgccuguaaaauuaaagguauuuucgcagccggaucgcuuaagugguccgccuggauaaaucgauuuucguaggcggauga

SEQ ID NO: 6779 - RNA, 338 nt, Oryza sativa
aaccaaguuaaaaugcucauagguaugaacaagcaucaauguuauuguagcgugguggugugaccucugugcacguaagcuugaggcagcaaguucgacuccuucaaaaggaagauuuguaccgcuggggaagugccagaagaaaagaacaaggaagacuugcuagcaggacaaaaggacgguaaacuuggaaaaaaaaagguccagaagaaaagaacaaagaagaacugcuugaaggagucgaacuugcuaccucaagcuugcgugcacauaggucacaccacuacgcuacaauaacguugaugcuuguucagaccugugagcauuuuaacuugguu

SEQ ID NO: 6780 - RNA, 159 nt, Oryza sativa
ucuguuaucgguaccaauauccuagauugcuuucaaggucauuucuuuauggaagcccauucccauaaauucaguauccaaagaugguuguuguaucuaaauagggguuccauaacgaaaugaucuuggaugcaaucuaggaguuugcugaugauaacg

SEQ ID NO: 6781 - RNA, 160 nt, Oryza sativa
uguuaucguuaccaauauccuagauugcuuucaaggucauuucuuuauggaaccccauucccauaaauuuauuauccaaagaugguugcuguaucuaugggaauaaggguuccauaaugaaaugaucuuggacgcaaucuaggaguuugcugaugauaac

SEQ ID NO: 6782 - RNA, 130 nt, Oryza sativa
uauccuagauugcuuucaaggucauuucuuuagggaaccccauucccauaaauucaguauccaaagcugguuguuguaucuaugggaaaggguucccuaacgaaaugaucuuggacgcaaucuaggaguu

SEQ ID NO: 6783 - RNA, 160 nt, Oryza sativa
uguuaucguuaccaauauccuagauugcuuucaaggucauuucuuuaggaaaccccauucccauaaauucaguauccaaagaugguuguuguaucuaugggaauaaggguucccuaacgaaaugaucuuggacgcaaucuaggaguuugcugauaauaac

SEQ ID NO: 6784 - RNA, 141 nt, Oryza sativa
ccaauauccuagauugcuuucaaggucauuucuuuagggaaccccauucccauaaauucaguauccaaagcugguugcuguaucuaugggaauaaggguucccuuacgaaaugaucuuggacguaaucuaggaguuugcug

SEQ ID NO: 6785 - RNA, 160 nt, Oryza sativa
uguuaucguuaccaauauccuagauugcuuucaaggucauuucuuuagggaaccccauucccauaaauucaguauccaaagcugguugcuguaucuaugggaauaaggguuccuaacgaaaugaucuuggaugcaaucuuggauuuugcggacgauaacg

SEQ ID NO: 6786 - RNA, 158 nt, Oryza sativa
uuuaucguuaccaacauccuagauugcuuucaaggucauuucuuuauggaccccauucccauaaauucaguauccaaagaugguugcuguaucuaugggaauaaggguuccauaacgaaaugaucuuggacgcaaucuaggaguuugcugaugauaac

SEQ ID NO: 6787 - RNA, 193 nt, Oryza sativa
caugucuagaaaucuguuaucguuaccaauuuccuagauugcuuucaaggucauuucuuucugaaaccccguucccauaaauucaguauccaaagcugguuguuguaucuauggaaauaaggguuucagaaugaaaugaucuuggacgcaaucuaggaguuugcugacgauaacguuaggggucuagugcaau

SEQ ID NO: 6788 - RNA, 118 nt, Oryza sativa
acccgucacugguaucuagucaccugugacgggccgagaauggaacccgucaaagggacaccucugacggguuccauucucgauccgucacaggugacuagaugccugugacggcccg

SEQ ID NO: 6789 - RNA, 136 nt, Oryza sativa
cgguugcagcccgucacagguaucuagucaccugugacgggccgagaauggaauccgucaaaggaacacaccuuugucagauucuacuuccugcccaucacaggugacuagauaccugugacgggccgcaacuuac

SEQ ID NO: 6790 - RNA, 100 nt, Oryza sativa
agaagauggaggcaccagcccaaggaaacacagacauugacacgcaauucaaggagaagauugcguccuacuuuuuccuugggaaggugguuucucuucu

SEQ ID NO: 6791 - RNA, 103 nt, Oryza sativa
auuauuaacucugauucuagaauuuuugcguuaaagcgaggacgagaacgaaaaacacuguaagacacuuuaacgcaaaaauuccagaaucggauccuuaucc

SEQ ID NO: 6792 - RNA, 86 nt, Oryza sativa
gagcucaaccgagccgaggaggaggccaugcgugcgguggcuguggagagccugcauacauugccuccuaggcuuggcggagcagc

SEQ ID NO: 6793 - RNA, 103 nt, Oryza sativa
uugaucucccaacugaagucgguguuuacucccacaagaugauacacuacuaguccacccuuaucaauuguaguacacaccagcauuccauuggcagaggugu

SEQ ID NO: 6794 - RNA, 58 nt, Oryza sativa
acuggaugugugcauuaauuggaagaacacaucuuccaauuaaugcauucuuccuaga

SEQ ID NO: 6795 - RNA, 72 nt, Oryza sativa
ucgggagaaguguggcugcuaggcuccugggugcaaccacacagagcuguggcauccacgucgagcgauggc

SEQ ID NO: 6796 - RNA, 87 nt, Oryza sativa
gugaaacugauaauuuuacgaugaauagaagguuauagauguagugacuaauuuaaucuuccauuuaugauaaguauaauacucaca

SEQ ID NO: 6797 - RNA, 237 nt, Oryza sativa
gacgccgcacugccgauuucccccucgggcgagccaucggagcgggggccguuggcucccaaagcagacgcgagaauucacugaaauuaccgcgccaucuuaucuccgcaaguugaagaauauaauucgggcgcaguaauuuuuagugaauucaugugucuacuacuacauaugucugcuugggagccaaccgcguuucgauggcucgccugaggggaaaucggcgggaggcguuug

SEQ ID NO: 6798 - RNA, 177 nt, Oryza sativa
guggggaagagaugggacgggcagggaaggaaguagauggauagaguuuggggauaggagggaaggggauagauuugguuguuuuucggaaaaaaaaaaaccuuguguuuuucauguuuacagugcugccccuaagagcagaauuuucucuucuucgugucgcauuucuuuaaaagc

SEQ ID NO: 6799 - RNA, 72 nt, Oryza sativa
cagucuugugccauucccguggaggcagccgaugaggauuaacgguuugucaagcggagugcacuucuaaug

SEQ ID NO: 6800 - RNA, 60 nt, Oryza sativa
cugcuuugugaauauguuuguacaagcuuuacaaagcuguagcguuauuccagagcaguu

SEQ ID NO: 6801 - RNA, 153 nt, Oryza sativa
uucccuucucucaaguugccaaacaagccaaguugccaaacaagccguaggguggguggggaagaucggaagaagcggcacucgaucgcuauuuuuuuucuuuuuaccgaucucuuucuguaaccgcuguuuaggcggaguggggagugggaa

SEQ ID NO: 6802 - RNA, 107 nt, Oryza sativa
ucuuaucucacauguuuacaaguuaaaauguggagcagaggguauacaacccaaacaaguuuggcacucugaacgauuuaacucaagugagcauugugcgaggccau

SEQ ID NO: 6803 - RNA, 109 nt, Oryza sativa
ccgaugguagggcaagccgccgccgccaccaccaccgcugccaugcggaugacaaacuucuagcucuucggauccauggugccgguuccgguggcguccauggcgacgg

SEQ ID NO: 6804 - RNA, 73 nt, Oryza sativa
cggcgccuuuuucccucuccgugcgcgcucgccggccggcgaggauggaugccgggagggagagacaagaggc

SEQ ID NO: 6805 - RNA, 105 nt, Oryza sativa
acgggcgcucacgguggcuucgacccucgucucggccgcgugcgguagugcgggaggcaugccguguguaccggcggcgaggggaugcgagcgugagugccucgg

SEQ ID NO: 6806 - RNA, 83 nt, Oryza sativa
uuuggaucugugauguauuucauuaagaauuugaguuguauuuuuuugagaauuugugaugugaaugauucauugauuuggga

SEQ ID NO: 6807 - RNA, 86 nt, Oryza sativa
ugcgagaaggauguuccgagaaucucguacgccggugagguuucccgugaucuggccgagguuuucuggauacauucaacgcggaa

SEQ ID NO: 6808 - RNA, 179 nt, Oryza sativa
gggaagaggaagaaagagaggcuccaagaguaguaggacugggaacauaugagaaagcaugagcucuauccaucuauccauccccucccauucgcuagaauguugcagguggagauuucgcucuuauguuuucucgaugccucccauuccuaucguucuuggaacuuccuuccucuucc

SEQ ID NO: 6809 - RNA, 179 nt, Oryza sativa
augagcgaggaagaggaagaaagagguagucuaagagcagugggaaugggaacauagaggaaaaaugagcucucaguguucacuucuggaaguggagguggauauuugucucaguauuuuucccgaugccucccauuccuaucguucuuaggugcuccuuccucuuccuuucagcucau

SEQ ID NO: 6810 - RNA, 97 nt, Oryza sativa
ugggaauaggaacauggaggaaagccuaaagcuaaauuuucugcuccaguauuggagcuagagauuugcucaguuuucccgaugccuccuauuccua

SEQ ID NO: 6811 - RNA, 176 nt, Oryza sativa
guggaucaggaagaggaagaaaagagggucugagagcggugggcaugggaacauggaggaaagcccaaacucuucuucgccucuagaacuaggggcugagauuugguuuccuuguuuuccugaugccucccaugccuauuguucucagaugcuccuuccucuuccuuuugguucgc

SEQ ID NO: 6812 - RNA, 177 nt, Oryza sativa
agugagucaggaagaggaagaaaagagagucuaagagcagcaggcaugggaacauggaggaaaaaacauauauaguuuucuuccccucuaaaguuagagguugaaauuugcuguguguuuuucccaaugccucccaugccuacaguucuuaggcacuccuuccacuuccuguuggcu

SEQ ID NO: 6813 - RNA, 169 nt, Oryza sativa
gugagccagggaagaggaagaacgagaggguucaauagcagugggaaugggaacauggaggaaagcaugagcucuaaauuuccuccaaaggagauccugcuuuguguuuuccugaugccucccauuccuauuguucuugggugcuccuuccccuuccuucuuggcuugc

SEQ ID NO: 6814 - RNA, 160 nt, Oryza sativa
gugaacuugggaagaggaagacagagggucuaagagcuguaggaaugggaacauggaggaaagugcaagcuccauguuuguggagacuuggcuugcaacuuuccuaaugccucccauuccuauuguucuuaggugcuccuuccucuuccuuuggucucac

SEQ ID NO: 6815 - RNA, 157 nt, Oryza sativa
ggaagaggaagaaagagaggaucucagaaauguaggaaugagaacaugaaggaaagucuaagagcuaaugucuccucuacauuggaggucgagacuuaguuucauguuuuccugaugccucucauuccuaugguucuagggugcuccuuccucuucc

SEQ ID NO: 6816 - RNA, 181 nt, Oryza sativa
gcaaguaaggaagaggaagaaauugagugucuaagggcaaucggaaugggaacauugaggaaagccuacagcgucuuucucguccacuagaagugggggguaaagauaauguuuuuguguuuuccuagugccucccauuccuauuguccuuagauacuccuuccucuuccuuucagcuugc

SEQ ID NO: 6817 - RNA, 171 nt, Oryza sativa
ggugagccaggaagaggaagagagacucuaagagcaguaggaaugggaacaugaaggaaagccaaauuaagcucuaaccucugguauuggagauuuggucugaugauuuuccugaugccucccauuccuauaguucuuaggugcucguuccucuuacuuucagcuaacacc

SEQ ID NO: 6818 - RNA, 177 nt, Oryza sativa
gcaagccaggaagaggaagaaagagaguaucucagaauugugggaaugagaccaugaaggaaagccuaagcucuauuguccccucuaguauuggagguggaaacuuaguuucauguuuuccugaugccucucauuccuauuguucuuaggugcuccuuccucuuccuuuuggcuugc

SEQ ID NO: 6819 - RNA, 177 nt, Oryza sativa
agcgaguuaggaagaggaagaaauugagugucuaagaacagugggaauggaaacauuaaggaaagccuacaguauuuucuucuccacuagaauuagggguggagauaauucuuuuguguuuuccuaaugcuucccauuccuauuguuguuagauacuccuuccucuuccuuuuggcu

SEQ ID NO: 6820 - RNA, 170 nt, Oryza sativa
ggugagccaggaagaggauagagacucuaagagcaguaggaaugggaacaugaaggaaagccaaaccaagcucuaacuccuggaguuggagauuugguauaacgauuuuccugaugccucccauuccuacaguucuuagguccuuguuccucuuacuuucggcuaacacc

SEQ ID NO: 6821 - RNA, 179 nt, Oryza sativa
gugagccaggaagaggaagaaagagagagccuaagagcagugggaaugggaacauggaggaaagccuaaaaaccaaauuucuuccuccagcaauggagguggaaauuugguuugguuuuuucccgaugccucccauuccuaucguucuuaagcacuucuuccucuuccuuucagcucgc

SEQ ID NO: 6822 - RNA, 155 nt, Oryza sativa
ggaagaggaagaaaagagggccaaggagcagugggcauggggacaugaaggaaugcuuaagccccucuccaauccucgcaugagauuggagauggaguuaugaguucuccugaugccucccaagccuauuguuccuuggugcuccuuccucuucc

SEQ ID NO: 6823 - RNA, 174 nt, Oryza sativa
gugggucaggaagaggaagaaaagaguaccuaagaguagugggcaugggaacauggaggaaaguucaaacucuucuuccccucuaaauuaggggggucgacuuguuuugauguuuucccgaugccucccaugccuauuguccuuaggugcuccuuccucuucccuuuggcacac

SEQ ID NO: 6824 - RNA, 177 nt, Oryza sativa
gugagcagggaagaggaagaaagagagccucuaagagcgaugggaauaggaacauggaggaaagccugaagcuaaauuuucuacuccaguaucggaguuagaaauuugcucugcguuuucccgaugccuccuauuccuaccgaucuuagguacuccuuccucuuccuuuaagcucau

SEQ ID NO: 6825 - RNA, 175 nt, Oryza sativa
gugagucgggaagaggaagaaaagagggucuaagagcagugggcaugggaacauggaggaagaacauguacuuuucuucccucuaaauuuagagguugagauuugcuaagcauuuuucccaaugccucccaugccuacaguucuuagguacuccuuccccuuccuguuggcuugc

SEQ ID NO: 6826 - RNA, 73 nt, Oryza sativa
aacaaccgggacuaaagauaucuugauaucuuuaaccgggaguaaagaaaagaucuuuagucccgguuguucu

SEQ ID NO: 6827 - RNA, 120 nt, Oryza sativa
gugcuaaucuaucgcuccguuuuccgugcggaacacagccgcggccuuaggcuguguucccaucuaccagaugggaacucauuuccccugcacggaaaacggagcgguccauuagcgcgu

SEQ ID NO: 6828 - RNA, 177 nt, Oryza sativa
gcgcuaauaagucguuucauuuugcgugcgugagaguuuucaagaaccuccugucuaaccaacccaaaauuggguuggccacguauaguccaaggaugugugugugagaugcauucauuuaugugcguugggaacucauucccuccgcacggaaaacggagcgguccauuagcgcgu

SEQ ID NO: 6829 - RNA, 212 nt, Oryza sativa
uuucaaaaauaaccuuuuguucagcgcaaaaucguauagcgcugaacuuagacaccucagcgccacgucaacuggcgcugaaugucgugccaccgugaauaggaggcugagucagcgugccaauguacauucagcgucgugcuauuuagcgcugaggugucuaaguuuagugccauaugauuuggcgcugaacaaaaugguaauuuuuuaaa

SEQ ID NO: 6830 - RNA, 161 nt, Oryza sativa
agcuuagcuaggcaucacaaaccauaaucuuuggcaguugaauuugagguuuggaugggaccaaaucuuacugcagacuugcagauuaacgcaagauuugguuuccuccaauaucucauguucaguugucagacagugaauaauggugcaauuagugagcu

SEQ ID NO: 6831 - RNA, 100 nt, Oryza sativa
uggcagcugaauuugagguuuggaugggaccaaaucuuacugcagacuugcagagcaagacaagauuugguuuccuccaauaucucauguucaguuguca

SEQ ID NO: 6832 - RNA, 109 nt, Oryza sativa
acuggaagugagaauuggaggaaaacaaacugauugcugguugaugcuugcaacaguguggcaaacaauuaauauucagauuguuuuucuccaauaucucaccuucagg

SEQ ID NO: 6833 - RNA, 127 nt, Oryza sativa
uuguucaggcacuggaagugagaauuggaggaaaacaaacugauugcugguuguuguuugcaacaguguggcaaacaauguucagcuuguuuuucuccaauaucucaccuucagguugauugcuuga

SEQ ID NO: 6834 - RNA, 121 nt, Oryza sativa
uggguacccauugucccauucuaguuuagcuaaaugaacuacuacagggaguaaauucuauggaccaggaaaagugaguuuuaguuaauuuaguugagcuagaaugggucaauggguaccu

SEQ ID NO: 6835 - RNA, 101 nt, Oryza sativa
ucuuuuacccacacuaguucaacuaaaugaacuaaauuucacuuuuagaaucacaaaaaaugaaauguaguucguuuauuuggacuagagugggucaauua

SEQ ID NO: 6836 - RNA, 114 nt, Oryza sativa
ggguauuucuugacccacuuuaguucaacuaaaaugaacuaaguuucacuuuuagagagucuaaagugaaauuuaguucauuuaguaggacuagaaugggccaaagaauaccca

SEQ ID NO: 6837 - RNA, 101 nt, Oryza sativa
ucuauucagcuuuugcugcccuuguuuugcauuguauagguauagcaauaugccauucuguaguggcauaccucuacagugcaaaacaaggacaacaagag

SEQ ID NO: 6838 - RNA, 101 nt, Oryza sativa
gaucugaauccucagcagucgacuguaccgugccuuugucauugauccacauguuagugaaaaaggcacggugcagugacugcagaggaucucaauccgga

SEQ ID NO: 6839 - RNA, 101 nt, Oryza sativa
acccuuuuucucuaguuuguguucagcaucuaugucaacuaugacgcugaacacaaacugacacagaugcugagcacaaacuagagaaaaagggucauauu

SEQ ID NO: 6840 - RNA, 101 nt, Oryza sativa
caauugacggcgugugccaucccacacaucccgaucauggcgugugacacaacuggaugugcgugccacgaccaggacgugugggauggcacauguuguca

SEQ ID NO: 6841 - RNA, 81 nt, Oryza sativa
ucuuuuguccuugguuuuguguaguagaaaaugcccacuucauuuuucuauugcacaaaaccaaggagaaauguacacaua

SEQ ID NO: 6842 - RNA, 161 nt, Oryza sativa
gggaggaggagcuucccaggauuuaauuuugggagguggugaguacuaaggagaacaguauguuguucagcuggcaggagcugcaaggagcaagccgcuggccaggguuugauccuugguacucauuaccucccgacauuaaauucugggcaggauuaagu

SEQ ID NO: 6843 - RNA, 161 nt, Oryza sativa
cuuguacuucaguuugucucuccaaacuaauuaguccaaugaacuucugauuacaaaugaguaaccacuaacuucugaguucugauuauggagauauaacuauugcaauuucuuuccaaaguucauugcacuaaucaguuuggggagacaaacugaaaugc

SEQ ID NO: 6844 - RNA, 121 nt, Oryza sativa
cauggugaccguagaaacuagcauagaaaaaaguagauaucucaagugacuuuguucauuuacguugggauagacaaguaacuaccuuuucuauuuuaguuucuauggucacuuugguggc

SEQ ID NO: 6845 - RNA, 141 nt, Oryza sativa
auggcugcccaccauggugaccguagaaacuaacauagaaaaagagguagauaucucaagugacuuuguucauuuacguuggaauagacaaguaacuaccuuuucuauuuuaguuucuauggucacuaugguggcagccau

SEQ ID NO: 6846 - RNA, 360 nt, Oryza sativa
cuuagauuauuucauaguucgguuuguagaauaccaucuucgaguucuugauuaaucacucaucugcaauugauggcaacaggaugcucgaucuuccaucagguaaagauaacucuugauuuggcgaaaacuugucacacaugauuugacuuucgaucaacacgaucuaaacuugcaauuucagcaccaugucuuuucuaguuaccaaccgugccgaaaucugauuggccuucacugagaaggcuaauccuugcaugcgaaucgaagaauacaagcaagaaaaagguagauuguagcucaauugcagaugaaugauuuagcacucgaaguugggguucuacaaaccgaacuaguggugaa

SEQ ID NO: 6847 - RNA, 101 nt, Oryza sativa
aauauauucuuaccaaauuucaaguucaaacucaacuuuauuugugagaauuuuuguuucucucaaaugaaguuaaguuuggacuuaaauuugguaacaau

SEQ ID NO: 6848 - RNA, 160 nt, Oryza sativa
uacauucccaccaaauaucaaguucaaacucaacuuuauuuaggaguaacagaaaagacauuuugggugaaugguaacaugacacuauucaccuagaauuucucuuuuuuguuucucucaaaugaagcuaaguuuggacuugagauuugguaugaaugua

SEQ ID NO: 6849 - RNA, 122 nt, Oryza sativa
uuaccaaaacucaacuuuauaugggaguaaaaaaaggauaaauuucgggugaauagugacaggguauuauucauuugaaauuuguuauuuuuguuucuaucaaaugaaguugaguuuggaca

SEQ ID NO: 6850 - RNA, 101 nt, Oryza sativa
acacuauguuugcacuguuuggaacuguucacauguugguucccggcaguaaaacugcuggaacuaacaugugaacagugucaaacagugucaaauagugu

SEQ ID NO: 6851 - RNA, 81 nt, Oryza sativa
ugaucaaauauaugaacuguagaugacuguaaauauacaauuuacagucauauacaguuuauauauuugaucguguuugua

SEQ ID NO: 6852 - RNA, 181 nt, Oryza sativa
uuuuugaggaaauugcuggcagcacuguuuauauagaaauuucuguaaaauaauugcuccugagcuuguguuugucauaaauguuaguuguuacuguagauguuucuuuccuuaaaaguuucccuaaacauucuugcuuguuuacaggaauuccuauaugaacacuguugccagcaauuug

SEQ ID NO: 6853 - RNA, 361 nt, Oryza sativa
aaucuugguuuaauguaucauccgauguccaaagugcagaugacgcagcuugggugcugauguggcaauccacgguggugagaauuuugcauuuagcccccucaugcuacaguaugccuucaagucuacucccaccacucccaaaucuuuuggugcauggcuuaaacuaugaauuugcuggaugcugagaaaugcauauuuguugauuuggggugguaggagucgauuucggggcauacuauagugaagaggcguaagugcaaaauucucgucacuguggacaagccugaguugcauccucugcacuuugggccucgagugauacauuaaaccaagauuaaggguguuuuuuagagggaaa

SEQ ID NO: 6854 - RNA, 101 nt, Oryza sativa
auaauguuucuuuaguucuuuacauguauaaaauucugaggauguuauauauaugacauccucaggauuuuauacauguaaagaauuaaacauacauuaua

SEQ ID NO: 6855 - RNA, 301 nt, Oryza sativa
ugcccagacgcgcucuggucauuauucuaacauauccggaucaacuggagagagaauuuuuagaaaggauguuugugcacuuguucaaccuguuuaacaaucacaaucagaucacaaaagauuauacugacacuaaauucaucugaucuaguacuuuauuuuuccgcauaaugccucuuguuuugacuacuugaucauuuuuagauguuugucaauggauggcacgaggguaaaagcgccauuuauaaaauuuaaucucuccaauugagccagauguguuaaaauaaugaccauaguaugu

SEQ ID NO: 6856 - RNA, 180 nt, Oryza sativa
augcuacaggacgguaucccguucggacaggaugauaccucagagguaucgucugauacccagguaugccaauaccuaguagguauuggcgauaccuugagguaucaucauguccaaacgggguaucagccgauaccuuagaugaucaucccgucugaacgggaaaccgucccguagcau

SEQ ID NO: 6857 - RNA, 81 nt, Oryza sativa
acugcacugugccuuugucacugacaugugggcccauugaucuccaggccuacaugucagugacaaaggcacgaugcaguc

SEQ ID NO: 6858 - RNA, 65 nt, Oryza sativa
gagcagcucucucuccgcccacuuggccaccacgcggcagccgagcgagggccucggggcagcuu

SEQ ID NO: 6859 - RNA, 65 nt, Oryza sativa
gagcaccucucccuccgcccgcucggccaccacguggcagccgagcgagggccucggggcagcuc

SEQ ID NO: 6860 - RNA, 88 nt, Oryza sativa
gcgcggcagccgagcgagggccucggggcgaagccgcgggagagcccgagggggugacgucaugccccgaggccccccccucccgcgc

SEQ ID NO: 6861 - RNA, 66 nt, Oryza sativa
gaggcaccccuaucuccacccacgcggccgccacauggcagccgagcgagggccucgggguaacuc

SEQ ID NO: 6862 - RNA, 165 nt, Oryza sativa
guaagcuucaugggcaaagaaggauggauuauuggcaagccugcaauuuuguugcacacuucugaugcuggagacagcugggaaagaauacccuugagugcccagcuuccugggaacaugguaaguuugcauauacauccguguugucugcgcuuuaacaaggau

SEQ ID NO: 6863 - RNA, 160 nt, Oryza sativa
gcggggagccgaugggccgcgggagaggagagagagagggagaggggagugggccgagccggcccaagagggaaggggggggggggaaagaggacuuuuuaggauuuuucuuuuuauaaaccuuuuuccacuuuguuuauuucuuuucaauuauuauuug

SEQ ID NO: 6864 - RNA, 210 nt, Oryza sativa
caagaggguuccuaaaauauuauagacaaaacaagucacuacauaauacauauaagcagauacagaaacaaguuuauuguccuauaccaaauuucaaaauucaaacaacaauauaacauuucaaauauuagcuaguuuacauuggguauucaacuauucaauaaacaccguggauaccgcauauacuaucaccauuuggccaauggccag

SEQ ID NO: 6865 - RNA, 240 nt, Oryza sativa
auaagaacuuaauauaacuuuaaagcaauaagaucuuaauauaaagggcagauuuagcauaacaauuaagcauaugauauuagaauagcuaaaucagguaagaucggcugaaacuccgauacuaucucuauaaaugaucauaaaacaagcuagauaucacaauuauagauagaacuuaauagaucgaacucaaccgaugcaacauuaagcauauaaaauaacuguaagaucuaaacaaga

SEQ ID NO: 6866 - RNA, 140 nt, Oryza sativa
uaauaauauguguucuucccagauguagcuuuucuuguuccaaauaagugauuaccgaaauucauguuccucacaagugacugcugaacaacaggugcaacuauaugcaaagggcugaauagaggguuaggaacaaucuu

SEQ ID NO: 6867 - RNA, 175 nt, Oryza sativa
uuacagacaaaaauauaaauaacaaagaaauaaacgccuuguaccuacaguacaaagaauuggaaucaaguugggaaauauaagcaccauaccugccuauuaugaacauacuccagauacgaagggacaucuggauaacgcauuugagugucacuaucagguauaggugauuuuu

SEQ ID NO: 6868 - RNA, 120 nt, Oryza sativa
ugucaucguccucugcagccuuaccccucguuugugccguggucgccgccugcuagagaugcguguggagcucagccuugccccucgcuugcuccggccgccaccgcuccgccggccugc

SEQ ID NO: 6869 - RNA, 120 nt, Oryza sativa
uucuugacgccgcccuuggcggccgcgggcuucgucgccgucucacugagcuuggcagccggcuccuuggcaaguccggcagguuucacggccuucagagaagccauucuucugaugcuu

SEQ ID NO: 6870 - RNA, 120 nt, Oryza sativa
guggugccucacgagcucacguacugcugugaggauggucgaggucgucgacguuggugcuccugccgucacgcacacaauggccaccaccacaggucacgaucuaucuccuugucuguu

SEQ ID NO: 6871 - RNA, 150 nt, Oryza sativa
ugucgcggccggcgagcaugaagcugacgacgaugucgcggagguacuugucgucgucgauggagcccaugaagcgugaaaggaggucgcugccgguggcagcgccgccaagcuuccgccguugucggaugaccuccgccgcgagcgcgu

SEQ ID NO: 6872 - RNA, 200 nt, Oryza sativa
uuuuauuuuggaaugaaggucagacuuuguuaaaaaaaaaugaaggucagacgucccagguuuugauuaaaagcuuccaaaauuuuaaguucuacaaagaagacgacauuuuguugaucacauuugcagguauuucuggacaucauaugcucuauuuucuaauuuguuaggaaaaaaagguuucaucuuuagaccucugg

SEQ ID NO: 6873 - RNA, 134 nt, Oryza sativa
ggcggagccaugaauuuuugucauguggggccgacuauuaauacuucacauuuuaaugggaucauuuaugcaaaucuuaauggauuuacacaugaaaauuuuaagacucucaaggguguuugugaaauaguugu

SEQ ID NO: 6874 - RNA, 180 nt, Oryza sativa
cgcgccucgccugaugcuccuuccuccggcggcugggcugagcugcgucgcgcuuggauuuuugccuccgaauuggcgaauucucuucucucgcgcguggccuuggguguggggcaaaguuuggcucgcuuuguaguuugcggcgauugcgggugggcgugagaauuuaaaaggggaggg

SEQ ID NO: 6875 - RNA, 154 nt, Oryza sativa
aaaaaacaauguuugccacuucuuuauuuuauugaugcauuuaugucuuuauuguugaugucaaaaauuuaucgaucagcgguugcauugaaaauuuagcuugaaguuauauauauauugauauacuugugguacaauuaugaacccccuccau

SEQ ID NO: 6876 - RNA, 140 nt, Oryza sativa
aaagaguauauuaaaucucucaucguuucucauguagugugcaaagcaggaccagggaacuuacuuaugcggcuacaacguaugcgaguaugcccacuaccuaucaaaccaaauaugcaccacacgagagcuugauguac

SEQ ID NO: 6877 - RNA, 114 nt, Oryza sativa
gguuuucuuggaucucucucucccuugaaggcuaucucauggagguuugauguacaccauuguugccuaagaaacugagaaagccuucgggggaggagagaagccaagcaagcc

SEQ ID NO: 6878 - RNA, 192 nt, Oryza sativa
gcggcgucuuccucuucuuccccuuaggagaaucgacggccucagucaggggcgccuuccccuugagcucgggagacgcauucugcuuuggcugggggcgcaggcuccggcgggcccuugucgucaccggaauuagacacuucguccuggccgaggccgucgauucuccuagcgggaagaggaagacgccgc

SEQ ID NO: 6879 - RNA, 192 nt, Oryza sativa
gcggcgucuuccucuucuucaccuuaggagaaucgacggccucagucaggggcgccuuccccuugagcucgggagacgcguucugcuuuggcugggggcgcaggcuccggcgggcccucaucaucaccggagucagacacuucguccuggccgaggccgucgauucuccuagcgggaagaggaagacgccgc

SEQ ID NO: 6880 - RNA, 126 nt, Oryza sativa
gaauauaauaacuuaaaaucgaaugggacguauccuauuacuauaagucugauaagucuggauaugaggcaugucuagauucguaguauuaggauacgucucauccgguuuuagggugcuauauuc

SEQ ID NO: 6881 - RNA, 219 nt, Oryza sativa
cgauguggcgcuccacguaggcaacaauuuugcauccggcccccuuuugcaggacagcguggugguaauauuguacuuagccccuuugagccacaguaccaccccgaaacuccccgaaauccccaaaucccuccucccucacaggagcucaaaggagcuaagugcaauuuuuggaugaggcuggacgcaaaauaguugccuacauggagcgccacgucg

SEQ ID NO: 6882 - RNA, 99 nt, Oryza sativa
gaacagaucaaaucaagcaucauaucguggacacggcaaccauauacauacccuucauuauagcgugccuuagauugauacccuugauauuguaccucc

SEQ ID NO: 6883 - RNA, 76 nt, Oryza sativa
gcugaauagaucgauuccccagcggagucgccaaaaaucguguuggcaacuuuuuugacaagucgacaagcacgau

SEQ ID NO: 6884 - RNA, 107 nt, Oryza sativa
auaagaauuaguuuggugaaucggaaacuauuuuucaauuuuauagaaaaaguccauguaauuuuaugaucaauaauaguuuucguuuuccccaaaccgucuaaacu

SEQ ID NO: 6885 - RNA, 136 nt, Oryza sativa
cgucauucgggaaggccaccgucgggaucgccaagucgucgccguccccguccgccgcuucgccgucgccgaagaucgccggagcaccgucgccgccgucgacccgaucuccgccgccgcuucuuccucgucgccg

SEQ ID NO: 6886 - RNA, 488 nt, Oryza sativa
gucggaggagcgggacgagugcgacgggauggcgaccgucgccggcgacagguuccucgccgugagcggguaccgcacggcgaggcagggcggguucgagcgcgacgccgagugguucgacccggcggcgcgcgcguggcgccgccucgaccgcguccgcgccccucccuccgccgcccacgucgugguccgcggccgcgucuggugcaucgagggcgccgccgugauggaguggcucggcucgcgcggcggguggcgcgaggucggccccucccccccgggccucaaggccggcaccgcccgcgccgucugcgucggcggcggcgagcgcgucgucgucaccggcgccaucgaggacuccgacggcggguccggccgccacgcccucuggguguucgacguaaagaccaagaacuggaccgugguucgcccaccuccagaguucgccggauucgccuucuccgucgccgccguccgcaucugauccg

SEQ ID NO: 6887 - RNA, 229 nt, Oryza sativa
caucugaucccagccuucuauugcuuuauuuucagucaauucaucuacuuguguaagaagaguagaguuugaguaucuagcaggguugaguauacauuugccaaauaauuuugcuguuauugaacuuaucuauauuuauacuaugccaaugaauucgaauuuuugaccuuuucucuccagcaugacucucuugacucgaaaugggagcagagcagguuugaaaaaagau

SEQ ID NO: 6888 - RNA, 91 nt, Oryza sativa
ugccuuuucguuguucgcgucggguucaccagcuaggugguucgccaugaaguacaggaagggggucgccggcgaguccaacgaugacgac

SEQ ID NO: 6889 - RNA, 435 nt, Oryza sativa
ggcuacaauaaaaugccacggcuaaauaggggguguucgcuagaaugucaucguggacgguauuucccuuggaucuucuucuuccuccaacaccugccaauucccuccaugucaugucgucgucccauggcagagcgcuccaaccuggcgcauccgaugaaguagccgucgcugcauaugcauugguuacagcagcaccagcacuacaggaugccaucgccgccgagcacgaaugugaagcagagcuccuugucuuggcagucaggcacugguggugggcaucaugagcugcugcuggagccaacgauggcaugacauggaggggaaugaccagcacccaacgucgagggaggaagagaagauccaagggcaauauuguccaugauggcauucuagcgaacaccccucguucgaccguggcauuuuauagaagcc

SEQ ID NO: 6890 - RNA, 406 nt, Oryza sativa
uuucuuauaauuuggaucuguuauuuugguaucaaucuauuaggaauagguuuacauaguuaugguucauuuacauuacccaucuaaaugauuacauaacauaaaaccuuaaugaaauggaaaaaacuuccauuuuuguguuugauuugagaaccccuugaacgccuucucaaaggguucucaaaaauucgagauagaucuaauuagacucuuuuacuuuuuucugaauuuuuuaguauuuccacuauggaauauagagcggacuaguagaagaaaaaaaauccuauuuaggauaauaauuggauaacagagccucuacccugucaacggauagcgagagaacaaaaucuggauaaauaccgauuccuauuacugguaaaaagauacagauuaaaagaaagaguuc

SEQ ID NO: 6891 - RNA, 406 nt, Oryza sativa; identical to SEQ ID NO: 6890

SEQ ID NO: 6892 - RNA, 89 nt, Oryza sativa
acacacauaccugcaggagugguuacuuugaagaaacgugaguucaggacauugaagcaaaaggaucauaccgugacagaguaucuuca

SEQ ID NO: 6893 - RNA, 250 nt, Oryza sativa
auagugacaaacuaucaguuuguugcaacauuagugaucuauuucaguuugcugcaauaauagcguggaaaauuaucacaaaacugcaacuuuuacgugauaugcuacuacaugacaauuguagcagcauaucacguacuguagcagcauaucacguaaaaguuacaguuuuaugauaacuucccaugcuauuguugcaacaaacuaaaauagauaacuaauuuguagcaaauugauaguuuuaucacua

SEQ ID NO: 6894 - RNA, 541 nt, Oryza sativa
ggcgggcgggugagcgcggcggccaugguugcggcggugguggcgcgcggcggcggcggcggcuagggcucaggcggcuuggugcgggagagaggcggcggcgaaggggagagaucgcuucgagagagugauuuuauagcgaggggauuaggguuuagcucuagugggccaugggggauaguuaguggaccacuaugggccgggcuagaauuaguugggccuucgcgagcccaacuugugggcuaguuuuucgcuuguaaaaggccauggggggaggaggcggcgagcuaggguuucgacccucacgaacacuacuugaucuuauccgagcuugccguccggcggcgccgcggcggccggagucgccucuccgacauucgcgccgccaccgacguccucguacgguuggcgggaagguggcgcgcuuuguugggggaaagaggcggguucgguucccguggcagucgccggcggugagcgaugacgacugcccgcggucggagcgcgugcgaugauggccgcgcggguucacccaaacaac

SEQ ID NO: 6895 - RNA, 380 nt, Oryza sativa
uccuggcaguucuucagauaaucagauuuguccaugagguuucaacuguugcauuccauuguugaguuuuauucuguuugcguuucuguuuguuuuugucauggaucuggcugauuggaggcugugaugaccaaaaaauaccuaccuauuuucugagggauuccaguccuucugauugauagaaaccaauggauccuucugagccugccaagaucuucagauucuuaguuuuguauucggcuuuuucgauuugucuucguauauugcauucuucuaaaagcaagcaagauucguaacaguugaugggaugauaaccuuucacagaaacuguauguguugacccaaaauucagacuacaauuaucugaucaacucagacau

SEQ ID NO: 6896 - RNA, 209 nt, Oryza sativa
ccucauacuuccucauugaccaauauaccacaaaacacuacaauguuggccucuuuaccacuaucaagacacuucucccaguccauuuugucuguugagcaucaggacauuaauaaguguggagugccuugcucuacaucauccucuguaaacagucugggguugcaguuuuaugugguauguuggcaauguaggaagucugaaucgua

SEQ ID NO: 6897 - RNA, 191 nt, Oryza sativa
ugacucaugcuuccauguugaccaacauaccaccaaaauauuaugauguucgcauguugcccuguuuaccacuauuaaucaagacacucccccuccucucuuuuguuuuccuggugaacaucaauauauugguaaacaggcuaagguuguaauuuucugugguauguuggcaauguaggaagucugaaugg

SEQ ID NO: 6898 - RNA, 423 nt, Oryza sativa
uccauauuauucuucuugugcugcugaagagacucaccgaccuccggcggcgacgucuucuucuucccauugaaggucucggucuucuccuucagcuccugcggcaugggacgacgagguggagcucgaguccucgaggaacuugugccgcaugggacgcccaccaagaaagccccccucgucgccccgccaccgccaccgccgccgccgaacaaccaagagucugaaucugauucugauuccgaugacggccaaaaguccgauuccagugacgacgaggcgcugccggugccgaacccagcgcuucaggccaacaagaaugugccuccguccgaugaugaugaggaugacgaccaagaguccgauuccggugaugcccgaggucggugagucuccucagcagcacaagaagaagaauaugga

SEQ ID NO: 6899 - RNA, 82 nt, Oryza sativa
ccaccuguuuggauucuugagggcuaauuuaaaauuaaaaugugagagcuaaacauuaguccauagaaccaaacagggccgc

SEQ ID NO: 6900 - RNA, 84 nt, Oryza sativa
uauaggugcugguucuuaaaaaaaccgauaccuauaguauuuguaccgguuuuaacuaaugaaccggcaccuauacuucguaaa

SEQ ID NO: 6901 - RNA, 366 nt, Oryza sativa
cuaguacucgcuccauccacgagaguuguacauauaacuuuuuucacagugaccaaggagaacacuaacuccucugauccauuuauucaucuauauggauucauacgcagugucguuucguuuuucccgcauaucgcgcauacgcaaccaacagccccgcccucgugcacuggugccgcaugcaugcaguugccuugccaauugcaugugcaugcucaacugguuggcugcucgggccgcguuaucaaauuaauccauccgcagccauacgauuacugcuucgaggcacaaacaaaauacguucaacucuuguggauaaacugagaaauguuaugcgcacaacucuuguggauggagggaguaaug

SEQ ID NO: 6902 - RNA, 76 nt, Oryza sativa
cacgauaugacguuuguaccccucacaaguacaaauauaaugcaugucaaugagggguagaaaugucauaucaugu

SEQ ID NO: 6903 - RNA, 78 nt, Oryza sativa
uacgauaugacguuuguaccccucacaaguauaaguauaauguaugucaaugagggguagaaaugucauaucaugugu

SEQ ID NO: 6904 - RNA, 79 nt, Oryza sativa
cacgauaugacguuuguaccccucacaaguacaaguauaaugcaugucaaugagggguagaaaugucauaucaugugug

SEQ ID NO: 6905 - RNA, 376 nt, Oryza sativa
cauauaggucccaaaucgcaacaacuccuccaaaauccuacguggcgcugauguggcgugccacacgaacgugacguggcauuuaaaaauuuuccuuuuccuuuuuuuucuuuucuucuucucuuuuuuuuucuuuuauucucuucucuuuucucugugaccugagcaacccguguagcgguggccuauagcugcagugagagcaagaaaaggagaagaaaggaaaaaaaagagaauaaaaaagggaaaugaaaauuuuuuaagugggucucauuugucauucaauauuaugccaugucaugucugugugucauugccacaucagugccauguaagauccuggaggagcugugacgauuugggaccuacaugacac

SEQ ID NO: 6906 - RNA, 79 nt, Oryza sativa
guuugggggagcuucugacagcugcaguuucucuuguucuaggagaagcugcagcugucagaagcucccccaaacaugg

SEQ ID NO: 6907 - RNA, 149 nt, Oryza sativa
guuugcuucacuaaugauguggguacgaaugaacaaaaaugugacuauuuuaagcuucacuguugaugacugauggcgacacgaguaacaugaagccuaaaauagucacauuuuuguucauucguaccuacaucauuagugaagcaaac

SEQ ID NO: 6908 - RNA, 216 nt, Oryza sativa
uaaagguagggauaggcaugaucucuuucucaccaaauuucuaagaccaaacucaacuucguuuggaaaguuaaaauaagacaaauuuugcaugaaacuucccuaucacuauccgugcaaaguuuguauuucuuguaucuugcaagcaaauuugaauuuggucuugaaauuuuguggagauauagaccaugccuauaccuaccacuaauauuuaug

SEQ ID NO: 6909 - RNA, 206 nt, Oryza sativa
ccacgauaguguauacguguuaguuggacucacgugcuagucacauagaauaaaauauaauuagaaaaacauauuuucuccucucuaccuuauaauuuuuaucuuuuuucugucuaccuaagaggagaaaauaugguuuuuaauuuuaauuuuuauauauguuugacauguggauuccacugacacguagacgucaccguggcauu

SEQ ID NO: 6910 - RNA, 121 nt, Oryza sativa
uuagacaucucagcaccaaauagcacggcgcuggauauacguuggcaugccgacucagccucccaucuguaguggcacggcauucagcaccaguugacgugacgcugaggugucuaaguug

SEQ ID NO: 6911 - RNA, 187 nt, Oryza sativa
aguuccugguacacuuuaauaccauuggaagauugcaccauuuaaguuucuuuuuuuuuguuacugugguuuuuugcaugaaaaaaaagaaagaacagguaaugcuaaacaguaauagauaaguggaugggaugguaaccaacuauguuguguuaucuuucggugguauuaaaguguaucagaagcu

SEQ ID NO: 6912 - RNA, 343 nt, Oryza sativa
ucgugaggcaaaagccuguaaaacugcaaaaaggaacauuaucucuccucucuccccuaguguuaccgggacucccgugucuaagaaaaauuugccgcgucgacacgcauccccgugucgauguguaucagacgcgggacgacgcgcaucggacacugcuagcgcgaguccaaguccaaaaggagaguugcaaucgcugcugcugugcugcaaggugaaguaauaaagcucuagcagcaguccuguaguguguagggauaaagcaugugggagagagagagcaggugagggagagaggagagagaauguccuuuuugcaguuuugcaggcuuuugccucacac

SEQ ID NO: 6913 - RNA, 93 nt, Oryza sativa
gccuuaagaacuuuuuaauagcuacaacuucucucuuagaaucaacucuucuaagagagaaguuguggcuaucaaaaaguuccugaggcccua

SEQ ID NO: 6914 - RNA, 93 nt, Oryza sativa; identical to SEQ ID NO: 6913

SEQ ID NO: 6915 - RNA, 266 nt, Oryza sativa
ucagaguaauucguccucaucccaaugcucgucaucuacgguuggaaaaagccaugaacuuuauguggcauaacggcucaccucuauggguacacaguguggaagcggacaaagucucuagcucacaaagaugaguggagaugacuuuguccgcuuccgcucggucugccugcauuggagaaccguugugccguguaaagggcaugaauucuuccaguuguugaugauggugagccacugggaugaggaugaauacuccgacaaca

SEQ ID NO: 6916 - RNA, 76 nt, Oryza sativa
uguaccuguugacugacucugguucaacaaaaccaauuuuacuuuuguugaacuagagugggucaacggguaccca

SEQ ID NO: 6917 - RNA, 380 nt, Oryza sativa
cuuuuugcagaaauauaccgucgaucucacauaaccauugagcaugacgucgugggcgguaucgugcagggaaagccggucucgcugauugaaauagcgauaccggacugccaccgauucaauuagugauuaauuaucaugauuagcgauuaauuaauuaauuauuaaucacuaaucaggauaauuagucacuaaauauuauuaguuaauaguuaauuagguaauuaaucacuaauuaaaaaguggagaucauugcaucagugagacagugucgcuguuucaaucagcgagaccgcucuuccguuccgcgagacugcgcggucucgcccuuuugcgcaacgguugugcgagaucgaugguauauuucugcaaaacaauuu

SEQ ID NO: 6918 - RNA, 276 nt, Oryza sativa
uucuagaauauacuaccucuguuccaaaauauaagcauuuccaggauucaaaucuuguuccacaauauaagcauuucuaccacuauuuacaccacuacuugucccaucaaucacuuuccauccaauuuuuuccccauccaacccccaacccccaaccccccuaacucucccucauuuauugaggggcaccaagucuuuuuuccucaaccuuaaucuuugcuaaacaaccuagaaaugcuuauauucuggaucagagggaguauaugauaguucacu

SEQ ID NO: 6919 - RNA, 182 nt, Oryza sativa
ucauuuuuguccaaaugaccaaaauaccccuagaacaaaaauuuccgaaauuuggauaaaauuaucaaaauaucauauuauuaacauaagcuuguaagcauccaaaauuuggccaaaaacuuaaaaucugacauuucagaauuuuugucccagggguauuuuggucauuuugacaaauuugu

SEQ ID NO: 6920 - RNA, 224 nt, Oryza sativa
uugagaggcguuuugcucaagaccgcgcaacgauuccauaugacaccgcaucguuguccaugccuaucauguucauccagagccccuguugaucuucagauaagagaaaagcucaaaauuaaagaaggcuuguuuauugaucaugucaaggauagguaucgacggcgaugcgcuggcuauggccaugguugugcgguucuugcgcaauaacguuuugaucucga

SEQ ID NO: 6921 - RNA, 238 nt, Oryza sativa
ccuucauuucaaauuacuugucguucuagcuuuguccuuaaacauguauaucuuugaccaucaauuuuuaaaaacucauaugguuuaacaucauaugauuuuuuuuuagauucacugacaaauacuuuaauaaauacaacucauauuuugaacuauacggauuucuaaaaauugauggucaaagauauacaugcuugacuuaggacaaagcuagaacaaaaaguauuugaguacuaga

SEQ ID NO: 6922 - RNA, 244 nt, Oryza sativa
ccuccauuucaaauuacuugucguucuagcuuugccacuagucaaacauuucuauuuuucaccauccauuuuuggaaauucguguagguuaacaugcaauauauauuauggaaguauuucucauggugaaucuaaaaacauaaaccuuaugauguuaaacuauaugaauuucuacaaguugauguucauauaaacauuugauuuaggacaaagcuagaacggcaagcaauuugaaaugagggga

SEQ ID NO: 6923 - RNA, 133 nt, Oryza sativa
aauuugcuucugaagcuucaguugguuguauucauuauuuucuuuagcacuauugguugauaaguucaucccugaugaagugcuagagaugcuacuaauauugacuccuucaaaaaaaaagauggggcauuga

SEQ ID NO: 6924 - RNA, 357 nt, Oryza sativa
augcuguaaggcaucguuaacagauagagaaucuucucagaaaauucuccaaauuugauguuugaaaucugacugauucuuugagaacugugagccuguaguuaagcuaucagcuugaaauccuuuacugcagcacuacauacuccggaaccuuguuacuguuauuagccaccagcaagccagcucaauuuacaguuagugccaccacaaaaggacucuucccaguuauauguaagcuauaccacccagauauucagcuacaccuugaaggcauaagaagcauaugcuuuuggauacaaucaaauggagaaucugaugggaauauucuuuaucuguuaacaacaaacaaaggcucag

SEQ ID NO: 6925 - RNA, 88 nt, Oryza sativa
gaaaaugaaagucugaagauuuauucauaucaucaugaguaaauuauuuuacuugugaugacguggaugaauuucaaacguuuauuuu

SEQ ID NO: 6926 - RNA, 292 nt, Oryza sativa
ggcggccggcugcggcgacggcggcuuggaugggucgccuuccucccuugcugcucggaugaacccucgccgcaugcaucgcgaucuugauauucuuggcauggaauuaauagcgucucuuuuuuaucccccuuacgguucuugaucuccagcgcuucucugaauucucugguucuucuugcucgcucaauuuacuuguuuuguuuucucgauugauugguugccugaucagcugugcuguggaugcaugcgauguugcaaaaccgagcgcgcuguugauuaaucuuaucuc

SEQ ID NO: 6927 - RNA, 118 nt, Oryza sativa
cuuggaguggugacaacugguagcagagcaaugucaucuccacuugccgguuguuccugguaugucgagggauacuggugcugacauugcucugauaccaauugucggcacucuaggc

SEQ ID NO: 6928 - RNA, 87 nt, Oryza sativa
uugcguugaaaggggcuugcauauucuaccacccgcuugagcagugucgcaucaaccuaggauuugcugggccucgcuccaccgcug

SEQ ID NO: 6929 - RNA, 220 nt, Oryza sativa
agaacagcuaaaagaugugcauguaguuccggcuuaauuaagcgaguuugguguuaugacaagcugguuggaguacucguauuugaugaacauccucauuuuaaaauuuuaaugauuggaagagugaaauauugaguagauggcaucauggcuaugcauaugcucucuucccauacuuaaaauuaauggccuguauugcaugucacacuaccgcuguugg

SEQ ID NO: 6930 - RNA, 213 nt, Oryza sativa
acgcauuugaugaaggcgacugaugauuucaggagacacaagaugaccuugcgcguggugauuggauuuuuacugucauuuucucgcagaaggcacagauuggaucauuacucugaacagcaucacaagcuugcaagaaacacaauccuuuuaaauaaacaaauuuuuuaucuguggaaucagauuaaccauuagauguuuucacagaaguac

SEQ ID NO: 6931 - RNA, 284 nt, Oryza sativa
ccacccuugcuuggaugccauugaaacacugcuagcuaaaacauaacuucguccacaaauucaucguugcccuaagaguuugcagacuuguagucauagacucuggugugcaaacuacagagaauacaugaagaauauuuccugaauguccuuucuauuaccuaucugucucaagcaauaggcuuuggagguuucaggaaaccacugcaucugagcuagagagaucaaagaguaaucuggauuuccuugccugcagguguucucgauggcuuccuugccuagug

SEQ ID NO: 6932 - RNA, 107 nt, Oryza sativa
gcuacuccauguccuaaagaaaccucauucagaagguguaccuggaugacauguauauacagguacauccuuaagauuggauuuuuauuuaggacggagggaguagg

SEQ ID NO: 6933 - RNA, 117 nt, Oryza sativa
accaugcggcauugacaaucugagugcuucauuuuauacacguauacuuucacagacauaagagcacguuguguaucaaaaaauugugaaauggaggcucguuguacguuguguacc

SEQ ID NO: 6934 - RNA, 173 nt, Oryza sativa
acaaugagggagaaggagaauagauaugguugaguuaauuauagaaaucauucuggugauuggauuuaaucagugucuucuugggaagugcaacuaauaaaaguuacacuuuuuuuucuaauaauugugguuuuagacucaauaacuguuguuucuccucucacccuauucau

SEQ ID NO: 6935 - RNA, 257 nt, Oryza sativa
cagaggcgggcuccgugccggccugcccagcugcagaucucggauguuucccugagacaaaaacagagaaggaagaggcccauguaagaugggcuuucaagucagcucaagcacccacuucucacuaccgauguccucuacaagcacuauucccucgauuaguaccauaccgcuugccgaacgacgccaagaccagcuuaaauacgcgcuucccaccaucuccaccagccgggcucggucgcgcgugccuguuacuc

SEQ ID NO: 6936 - RNA, 118 nt, Oryza sativa
auuuguuucuuuauaggagguauagacgguagccacgucacuuucuuuuugccuaaucccaugcacgagaacugaagccccucucuguaucuugauaugacaucgcauagaaacaaga

SEQ ID NO: 6937 - RNA, 264 nt, Oryza sativa
acauaacccgagagguccggaucgaacguaggaauagucaagaaaauggcaaacaaacguaccgcguauugucucuuacagccuuauagcacauucugcacucuugucucaugggcugugcacauuguuuugauacccauggagaucauugugaccucguuggccugcgcaagccauuucacuaucuucuucucccagggugcuaugugaauuaauuucuugaacucuuagacuuugcuuugauccuggccuuucuugaaaugg

SEQ ID NO: 6938 - RNA, 86 nt, Oryza sativa
ggacgucaugccagccgguggcauaguucucgugaagcccggacgaguacuagcguauccgcugaguacagauuaucgagacgucg

SEQ ID NO: 6939 - RNA, 138 nt, Oryza sativa
aauuguugcccagaauaucugggacgagcaugauaacaugugcacaguauagcucggacuuguuaaucuccuaauguuggcucucccaaugccuuccauucucacacacucuucuauauguuuucuuggguagauagc

SEQ ID NO: 6940 - RNA, 145 nt, Oryza sativa
aacuggugguugagcuguaacacuugaagacgcaacuugcacugcauuggcuccugugacgacaauguuguugacuugaccuugcggcugcugaugcuuuggcuucgaacacucucuugcaaagugacauggcuuguaacaguug

SEQ ID NO: 6941 - RNA, 125 nt, Oryza sativa
uucugcuguuccauguucgauucuucauuuggggaucuaacaucagcgggaaccuuaagucuucuucacauauccauuugauggauagauugccgaaggaagaaucguuauggaaugaugcagau

SEQ ID NO: 6942 - RNA, 88 nt, Oryza sativa
aggauacgccugccccgcucgauuaucacugaugauuaauuuucaaaagaagaauaucacugaugaaaucuugcggcggcuugugucc

SEQ ID NO: 6943 - RNA, 366 nt, Oryza sativa
aucuuugccgauuauuccuucugcaccacaaggaugccaugagguucccuuccuucuguagacagauauggugcaagguggaacuuuccacaugauagggaaggcaccgugagguagggaauggugugccuuccuucgugcaagagggaaaagagggaugucagagccagcauagaugauugcagcggaccagggugauuggagcaggcuccuccccuuguuuggugccgguugguugugccugcuauggcuuucccugccagcaucaagccaucaacugugaugggggugcgcaagggagggaugcacauuugggauaagcaaagauguugaucucuuguggcuagaagggugaggggcaaaaua

SEQ ID NO: 6944 - RNA, 142 nt, Oryza sativa
aggauggucugugccgcgguccuucugugucuuggcuugaacaagggcucgugcccaggucccagccucaaacggcgcgggucggggccugcguuaccccgauacgcugauacggauacggauacgcgauacgguguuaccg

SEQ ID NO: 6945 - RNA, 256 nt, Oryza sativa
uuuugcuagaccucccuccuaucaggaucugaagccaaccuauuacuauuagccauacaguuuugcaaacugauucugauucuucuaaggaucugauucacggagaauccuuuggauuuccuuuuuugaucaaugauaaccucugcauuguugucauagcguauuauuauaccaucuucgcauuugaacucuuuacauguauguacaauuacaccucaaauuacuucggaucuuucuagaggcauuuggggcacug

SEQ ID NO: 6946 - RNA, 98 nt, Oryza sativa
auugcugaauuuuguucguuggagcuuguucuguuauuuuauuugcacugccguaggaaauacacagugacgggaggacugcaagguucuucagcuuu

SEQ ID NO: 6947 - RNA, 208 nt, Oryza sativa
cauuggcacuauggcgcauguauguugaguucuugaagcauugccgauaucgauauauauuucuuugcaugggacaguagccuuuucugcggcggaucguuuccuuuucuccaaucauaaauaaccugaucucuuucuuugucuuucaucaaauaaguacaagaauugcauagaugaggauucgguauugaucgcuaaaaugcgagaa

SEQ ID NO: 6948 - RNA, 111 nt, Oryza sativa
accaguuguauggaucgcuucgucugaugguccuccuauugacucaaguggacgugacugaacccuaggagugcucagcccaucaaggugacgucgaugcagaugacauug

SEQ ID NO: 6949 - RNA, 245 nt, Oryza sativa
aaagcauauauuggguugucgguuuucauaaaaaaacagucugguucagccaguucuagcaggucuaauugcauggacucucuaugaggaaauacgauccugugagggugcugguuagcugcaccaaugugauggaggccccagcugcauagcgcgcgacucacgccagcagcgagcgcacucuggaccauacaucagauuccaccacgauggcaaugagaaugaugacccggugaaaugacaac

SEQ ID NO: 6950 - RNA, 153 nt, Oryza sativa
gcuauugaacuagauggcugaucugguguggcuuggcuuuggguaagaaggauuggccucugucuagugccucacuuuccuucugcgguucugucuacuguccugguuuggaagaagucaaaccaagccagaucagccaucuaguugagucuc

SEQ ID NO: 6951 - RNA, 236 nt, Oryza sativa
uuuccaagccuaggcauuuucucuuggcaugcugugcagcuuauuccaggaaacauuauauugaacuuuaguagaggaauugcauauuaaaguuuuucuugaaguaagucaaguaaauauuuuuggugacaggcuacauuugggauagcagggauaccgucuagugccuaaugcgugccuuuggauucgaaauggucaggccuaucgcccugugauuguuauuucuuuguuggguu

SEQ ID NO: 6952 - RNA, 125 nt, Oryza sativa
guuggcucaaaggcugauccacuccagaggagguuucguaggacagauccccucgauucauugucacucguucauggaucaucccgaugaacauccucaggaguggauugggcuucaagacagca

SEQ ID NO: 6953 - RNA, 128 nt, Oryza sativa
uugguggaagaaggccaaguguuugggauguuggaaauaacuuccuagcuggcuggccuaagaaauuuucauagacaaagagccguuucaaaccaugcauaucccagcuguuucggccuugcugcauu

SEQ ID NO: 6954 - RNA, 137 nt, Oryza sativa
cucuuguauuuuuuuuuagcauuaccauauccuauuuggcaaugaauuucauauacuagaguauguucuuaagauuggauugucuaaagugaaauucauugccaaauaggauaugguaaugcuaaaaaaauacauga

SEQ ID NO: 6955 - RNA, 132 nt, Oryza sativa
auguauuuuuuuagcauuaccauauccuauuuggcaaugaauuucacuuuagacaauccaaucuuaagaacauacucuaguauaugaaauucauugccaaauaggauaugguaaugcuaaaaaaaaauacaa

SEQ ID NO: 6956 - RNA, 146 nt, Oryza sativa
gucauuauucuucaguccguuguccuuugugauaacauaucuguacuuauacguuuguucauuuaggauagacaaggcucaaagccacgcuagcugacauuagccggauauguuauaacaaaggacaacagacugaagaauaauga

SEQ ID NO: 6957 - RNA, 104 nt, Oryza sativa
uuggacagcuucccagagcuuuggccgucgcuccggucuucugccaugacaucaaucuuuggaccgccggcgacuggccuuguucugggaugaacuugaacaga

SEQ ID NO: 6958 - RNA, 124 nt, Oryza sativa
aaauuguuugguucaguuggggagacgaucacgccuuaauuggaaugagagacuucgggaguuuuaguuauucuauuuggacacccaaaugggccgaugguuguucuacaggugaaaacaaugu

SEQ ID NO: 6959 - RNA, 95 nt, Oryza sativa
ggaggugggagucaaaccauaucaguuuccgugggagugagaagcauggggaaauuuagcccaacucauugcuucgguaggcuggcgaccaauuc

SEQ ID NO: 6960 - RNA, 69 nt, Oryza sativa
ucucaguuuccgugggagugagaagcauggggaaauuuagcccuacucauugcuucgguaggcuggcga

SEQ ID NO: 6961 - RNA, 103 nt, Oryza sativa
caaaucaauuugcaucacggcgcauauguagaaccccguucaguugacuacaauaguaagccaaacgaaugcagcguugugugccgcaauguacguacagcca

SEQ ID NO: 6962 - RNA, 163 nt, Oryza sativa
aaucaaggagagaauagucccgauuccugcuuacugcaugccuuauuuggaugugcccaaauucagaccgggucacauauauggugcauuuuaauguaaaaucuagggccaaacauaaucacgauucuuugcauacucaaacagggcauugcaguucauugau

SEQ ID NO: 6963 - RNA, 70 nt, Oryza sativa
cugugggcguuggcagaaguacuggacuuagcgggcgcuagggcuucagcucauucugcuauguccgcau

SEQ ID NO: 6964 - RNA, 184 nt, Oryza sativa
augaauguucaguggcugcauaucugaugagccacgguaaaauccuugagcaaacuguucugcuuccgugccucucacagcgcugguuccagugcauaugauucagauguagaggaacaacacauaaaucgucuauauagcuggaagagacucgucauuugggaucagugaguugagcagucga

SEQ ID NO: 6965 - RNA, 113 nt, Oryza sativa
agcaccuaagaacaauaggaaugggaggcauuaggaaaguugcaagccaagucuccacaaacauggagcuugcacuuuccuccauguucccauuccuacagcucuuagacccu

SEQ ID NO: 6966 - RNA, 84 nt, Oryza sativa
uacuagaaaacaaguaaguguaauucccccuaaacauuaaaauauguugacaugaggaggaacauauuuacuaguuauauuguc

SEQ ID NO: 6967 - RNA, 284 nt, Oryza sativa
gaagaauggcgguaaucgugacauuauuucuauuaauaguaaccaaauaauauugucagaugugaucagcaaaaguaucaucaacaaagguucaaguuuguauauguuuugguuugaguaagaagauagcgaaugaaaaggaaugccccuugcauguugagggauugguauguguuaauuguuugagucaagauauuuuuguagagacuaugcuaaucgcaguuaagaaucaacaguucuagagagauauauauggaaaauguguucaugacggucuauucaau

SEQ ID NO: 6968 - RNA, 208 nt, Oryza sativa
gauguacaagugaaccuugggagcgaucugaaacgaauuccuuguucucaugaaaauagucaugaaugcggccccaauguguuccaugagauugauccaucccuuuaccgcauuaaaagaaacauuuauccaugccgacaccaaaagguugucuuccuccaaaaugaauuuuucggaucuuuuuugguuuggucucacagcagcauuu

SEQ ID NO: 6969 - RNA, 253 nt, Oryza sativa
ggaugugggauucaaacucaagaccucucaccucagcucucaaacacauuaccauaccaucuacuacacacaucugacuuggauagagauguuuuuuuuaacuaagccuagaagcaucuuucaccaaccgauacuaaaaauaucuuuaguucuaguugguaacaccaaccuagacuaaaaauucuucuacaauucgaaccuacacauucuaagggcauauacaaagguagagucagguaugagcucuacguua

SEQ ID NO: 6970 - RNA, 365 nt, Oryza sativa
ugaagacaguucucagccagggcaguaacagguacccaauucgagugguguaggagcaucugaugaaccaacauccgcaguuuuguuucgccacuguuccuaucaagcucuucgucauguuuaugcguuauccugauccaguacccuccuaaaugacuaucauccuuccugaugucuaucauucucacagccuagcuuucuacucccggaugcgugauucguuggaugacagaaaggcgaucugaaucuaggaugaucccguggaauccuucuuccuuugcuaagaacaggguuaauuuggcgcacugccacugccucagcaacuucuggcacucugaucccugagacaagcucauuggauacaa

SEQ ID NO: 6971 - RNA, 73 nt, Oryza sativa
gacaucaguuugcaguaucuuuaccaaggucugguacugcccaagacgguuuuagauguugccuccugaucgu

SEQ ID NO: 6972 - RNA, 331 nt, Oryza sativa
auaugugugagcgugguguugcgugugauguuuguagugaaauugaaaaaaaaaaguagguuuaguaugcauaaauaaauguucucauuauuuguguggaugauuuagaaacggacgaacuaauuacauaccgggguaagaucgauugaaauuccauuagagcgcaaugaauccccgagacaauugaauuacaccaaugaucgcccaaaaaaauaaagaguacaaagucaugucaccgaggcuaaauucgccucacuacuuguguggauguacaaaagagaccauuaauuucaaucuacaguuucauccauggacaccgcauuguccauug

SEQ ID NO: 6973 - RNA, 118 nt, Oryza sativa
acuguuggcgaguggugucguauuaccugcccuuauaggacaugaugcaucaugcaugcauuauggcugggagcaugauaugauaccucuaguauguaaacuaauaauuaguagcagg

SEQ ID NO: 6974 - RNA, 88 nt, Oryza sativa
ggauucaagcuggugacugacugccuugagcuccgggcaugguucuaccuugcacuugaggaguaugaggcugcagugcgggauauca

SEQ ID NO: 6975 - RNA, 154 nt, Oryza sativa
ccucuuuuggauucuuaagaccacccuuguaguaggauaccgucugcuuuggguucuuuauuauauuaucuccuucgagggauuuuuaggaucguuuaggcuauauuuagucuauuuuggcuauggaauauaugacaaagguggagucuuggag

SEQ ID NO: 6976 - RNA, 276 nt, Oryza sativa
cucccugacuccucuuugccagaagcccucauggcagcuguugagagaggugcucaugcaccucagauggggauacgccaagcauccuuauuuuauagcugccauagcaauucccugauaaggaugcuuggcguauccccaucugcuggcagcuauaaaauuuauagcugccauagcaauucccugauaaggaugcuuggcguauccccaucugaggugcaugagcaccucucucaacaguugccaugaaggcuucuggcaaagaggagucaggga

SEQ ID NO: 6977 - RNA, 102 nt, Oryza sativa
aacuuuagcgccuugacgacaacagcuagaauggucgcggcgacgaaggauugucccccgaugaggccgccauucuagcuguugucgucgaggcgcuaaagu

SEQ ID NO: 6978 - RNA, 98 nt, Oryza sativa
aacuuuguucgaugacaacagcuagaauggccgcggcgacggaggauugucccccgaugaggccgccauucuagcuguuguugucgagacgcuaaagu

SEQ ID NO: 6979 - RNA, 328 nt, Oryza sativa
cccgaacucgucugcgugauugaagucugcaucccccaugagaggaauagugucuuuggugcugccaugccaauccgaucuauucccuuucuuuuuuuuuguuuuuguuuuuucauguuugcaugaucggugaucaggccuuuuuuccccacgcuguucagauucauggugguuuuucuugucgauucaaucuucuaugcuuuaugguugcaauuuucccagguuuuaguuuaguguuuauaacuagacaugaaaagacaagauauguauuuuuuucgcagggguagagugagaauccggaugcagcaucaaugcagaugaggauuau

SEQ ID NO: 6980 - RNA, 146 nt, Oryza sativa
ugaggauccucuaacauaauaucauuaucauuacaguuacugguauguagaucucacccuccuauugccccacauaucauugucuauauuuuuuuuaggaaugucaguaccuauaaugguagugacauuaugguagaggaugugaa

SEQ ID NO: 6981 - RNA, 130 nt, Oryza sativa
uuguuuuauuaauugacuagaaaaauguccgugcauuacaacgggugaaaaauuucuaaugauaauauauauuuuucaugcauaaccaugucaauggcaauguuuguauggaucguuuguagcuaaaaca

SEQ ID NO: 6982 - RNA, 123 nt, Oryza sativa
augaggaacuacugaacucaaucacuugcugccguuacucaacaguuuucuguugaggucuaucccguagagguagucaaauuagaacgggaggagaggaggugaguagggguaguucaaugg

SEQ ID NO: 6983 - RNA, 76 nt, Oryza sativa
gauucaaagcaagaaaacggaugcgcgugcuaacgcuuucgcgcuagugcgcucaauccguugcuuguuuggaaca

SEQ ID NO: 6984 - RNA, 76 nt, Oryza sativa; identical to SEQ ID NO: 6983

SEQ ID NO: 6985 - RNA, 343 nt, Oryza sativa
uuuugcgauaauauaacgucgaucucgcacgaucucgcacaaccguugcgcgaaaaugacguggaugugacauugcagacgguauugcgcauugaaaguacgagaccgcaccgugcacgauaauuaaucacuaauuauuauuagcuaauaguuaauuauguacuugaucacuaauuaaauggagccgguuaauacugucgcagacuguuucagcaagaccucgcucuuucauuucguaagaccgcgcggucucgcacauagcccacgcgauaccgccugcgacgucacgcauccguuauuuucgcgcaaugauugugcgagaucgacgguauauuuucgcaaa

SEQ ID NO: 6986 - RNA, 194 nt, Oryza sativa
guccaaugagucaagugguguacucuaaagaaaaaaaaucuaauuaauuuaaccaccuaaaauagcuuuuccuuuuccuuuuugggauuuaucacccuaaacuacaauacauaaaucccaaaaaggaaaaaaacuauuuuacguggguauauuagacuuuuuucuuuagaguacaccacuuaacucauuggacu

SEQ ID NO: 6987 - RNA, 152 nt, Oryza sativa
uucuacggucuuugagaagguaucaugagauacaaaaaauuuaguguaaaauuuaguaucuuaugauaccucauaguaccuagguaccauaagauacuaaauuuacaauagaaaaaaugguaccuugugauaccuccucaaggaacguaaaa

SEQ ID NO: 6988 - RNA, 102 nt, Oryza sativa
auugaaaucauaugaaugguauauuuucuugcaacauguguaauuaauaccaaagcaccuacacauguuacaagaaaauauacgguuuauaugauuucaguu

SEQ ID NO: 6989 - RNA, 205 nt, Oryza sativa
uuguugugacaccauuuccauuuaguuuuucauacaccauuaauuuucuuacuaacaaaaucuuaccaugcuauagauuucagccucuuauucucauauucuuguucuaauuaugcaccuugugaauccauagguuguucuuguuguucgauacuuggagcaucguuuggaguagaacacggaguagaaguuggugucaaugcag

SEQ ID NO: 6990 - RNA, 116 nt, Oryza sativa
aaaaaaacgauucuagaacuggaugugacauacucuaguacaaugaaucuggauagagguauauccagauucguaguacuaggauaugucacauccaguacuagauugauuuuuuu

SEQ ID NO: 6991 - RNA, 65 nt, Oryza sativa
aauucauaccaaauggagacgaucaguaccaaaggcuggugacugagcuucguucgguaucgauu

SEQ ID NO: 6992 - RNA, 83 nt, Oryza sativa
aagacgauccuagcagagcuucaucuccacuccacagguaaaacucaacugggguauaagccugaguccucuaacuucgucuu

SEQ ID NO: 6993 - RNA, 149 nt, Oryza sativa
ugcugguucagauggaagaguaaaauuagaucuagugcauugcuauguuaggccuaggaggcaccaggaacuuccuuguuuggugcaccaggagcugaagcauugcaggagacuagagaccagcauuuuggucuuucaaaucaucagca

SEQ ID NO: 6994 - RNA, 77 nt, Oryza sativa
cgucgaugacagcggugguucggacaucuucggcuuuguaccugcuuggcuugauggcaucaucguucuuaucgaug

SEQ ID NO: 6995 - RNA, 78 nt, Oryza sativa
acccgaggacgagauacagugcagcaucgcgggacggaaaucuuccuuugcguguaccuucucuugucccauccuggu

SEQ ID NO: 6996 - RNA, 436 nt, Oryza sativa
caucgauauggcugcaagacuguuugcgauuccccaugaaauccaaauauggaaaucaaaaggcuugaaguagauacuguuggcauacacacaaccauagaguucaucuucagaaccaaauccacguucuugaaaauaugaggagggugcugcuggaagaacaacaaucgcucaucgugauggcugcccaccauggugaccguagaaacuagcauagaaaaaaguagauaucucaagugacuuuguucauuuacguugggauagacaaguaacuaccuuuucuauuuuaguuucuauggucacuuugguggcagccaugauagacagaaacaaaggcucaccgaugaaacccaggacuugcucuacuucaagcuuauuguuuucuauauucuggauuuccugaggaaucacuaguagucguucagcgauauccaug

SEQ ID NO: 6997 - RNA, 219 nt, Oryza sativa
ugguauacugaugucgaggucgaguucccggcugcuccggcccuauugaguauggaugcuaugguuucgucgacgaggcgaacguagguaggagauagagguauaucaaaccauaagagaauguguguagaugcaauuuuguguuuaaaaaguacuuucuccccguacaacagugacauaggacaugucgcagcaaggcgaaccgaugucgacgaccac

SEQ ID NO: 6998 - RNA, 171 nt, Oryza sativa
gaucggcaugggaggguuugggaguugaguuuggacaauuacaugagagucaccuuccucauggguagauaccuguuucccaagcuaucauagggguugcaggagcugccauugcacagggagucuuuggacaggauuguucauucaggauugaagccgccaaugccagca

SEQ ID NO: 6999 - RNA, 66 nt, Oryza sativa
ucacugcuguucgugggauuuaugcaguuaaugucguuuugccugcugauccuacuuauacagugu

SEQ ID NO: 7000 - RNA, 157 nt, Oryza sativa
uugagaggcaguccgugcuauguggcggucauagggagcgcauuuggcaagcuugagcguugugguggcaguacucucuaaguaauuuccauugcaguguucuuacgaaaguugcuaggcacccugcuggacuacaagaucccggauuccaucuccc

SEQ ID NO: 7001 - RNA, 124 nt, Oryza sativa
uuuuugaaauaagacgaauaaucaaacguuggacauaaacaguguaaaauuguugucuuucuaggacggggguaguauuuaucaauuuuagauuuaacguuuaacuauuuaucacuuuuagauu

SEQ ID NO: 7002 - RNA, 93 nt, Oryza sativa
agcaggauaucaauagcuaggauugagaggcaucaggagagcaccuucaacggguaacuuuccaucugcaucccggcuaucggaacggcugcu

SEQ ID NO: 7003 - RNA, 79 nt, Oryza sativa
ucacgauaccaaaucguuuucgaucguuggauuauccugccgagcuagaucaacgaucgaaaacguuuugguacuguga

SEQ ID NO: 7004 - RNA, 64 nt, Oryza sativa
agggauauggacuguacuuuguaaagcggacucuuuccccuauauaaggaggguucgugugccu

SEQ ID NO: 7005 - RNA, 87 nt, Oryza sativa
uaauguuacuaccacuguagacgcuacgugugagauaauaggaggauauaacccacguaucagcgccuguaaugauagugacauuau

SEQ ID NO: 7006 - RNA, 127 nt, Oryza sativa
gaucagauugcaucggcaucucuacucugcagccgcugccucugccgccucuuucauccgcuguccgugcgacggcaagagaguguugacagcggcugcgaaguagagaugccgacuugaucugagc

SEQ ID NO: 7007 - RNA, 407 nt, Oryza sativa
cgacaucagcacgagugauggcggcguauaccugcgggaaggcggcggcggcaugaagguacaggggcaagcagcugcgcggcgcagccugcuggagcaccuccaagacguugcggcacuuguucugcucaauacacaagcaaaauaaugaggauagcuagcguuuggggaugggccaggcggccaacaugacgagguaaugauggagcugcuugugcgccggcagaaguagugggacugcauggauauggccacacagacacccaguuggccugcaggcucuggcaucgaaguucuucucgcgccccgggagcacugcgcugcagcugcuugccccauccgccuccaccacgccgucggaugucgccucugcaggugcacgccgucgccacccguguugaugcuga

SEQ ID NO: 7008 - RNA, 81 nt, Oryza sativa
ggguccgagcugcauuuggauuagccgaucuggaaguuagcaaguuagaaacaggcaaagacaaugacggcucuuggaugu

SEQ ID NO: 7009 - RNA, 353 nt, Oryza sativa
aucugaaaguaggaggucuggagaguuauguggcaggaagccaagccaggaaauguaauguaaucgacagcucuaacugaaacaucccuuauaaguuauuuuuagggaacaaacccuuauaaguaaucacacuucauaaugaggcacauuacuccucuaacugaaacaucccuuauaaguuauuuuuagggaacaaacccuuauaaguaaucacacuucauaaugaggcacauuacucaucuauaaaaucaauguggauagauugaucaucaugaccuacaugugagcugucgauuagauuagauuuccuggcuuccugucacauaacucuccacgccuccuauuuucagauu

SEQ ID NO: 7010 - RNA, 79 nt, Oryza sativa
uacuaaaucguuucugaucguuggauuuagcuggauaagauauguauuauuggauccagcgauuggaaacaauuuggua

SEQ ID NO: 7011 - RNA, 63 nt, Oryza sativa
guaaacgcugguagcagcggcgacgagaauagauggcgucgucgccggcgaccacagcacaac

SEQ ID NO: 7012 - RNA, 128 nt, Oryza sativa
gugcuucauaaaugcuuuucuccacuuaggguuccguuagcaacccuccauuaaguacuauaggaugaacagugcauuuaucggugugggauggacggaacccuaauggcgauggcauuuaugggaca

SEQ ID NO: 7013 - RNA, 77 nt, Oryza sativa
aaaaaaaaaaccuaaccuaggaguucgaugggacauaagauuaugucucauccaacuucuagguuaguuuuuuuuuu

SEQ ID NO: 7014 - RNA, 62 nt, Oryza sativa
uagcaacgauuuuaagauuguggcaauauguaucuauugcaauaauuuuaacauugaugcua

SEQ ID NO: 7015 - RNA, 135 nt, Oryza sativa
uggugagcuaauuuucaugaccaggucacugcuugccuuugcaguaccauuauggguuaccgugccagauugagggaaggaaugaaaaggguaaagcaaaggcaagcagcgacucuggucauggaauuggagcca

SEQ ID NO: 7016 - RNA, 108 nt, Oryza sativa
ggcuacugguaaucaaguuaggaaccaugcaaguuguuuaugaguugugcccucugugccuagcgccauagaugacuugcaagauuucuaacuugagugccagugucc

SEQ ID NO: 7017 - RNA, 112 nt, Oryza sativa
aauguauuaaauguuauggacacuagaugacauaggguugaugauggucuaauauguugucuuaugauagaaaauuaaugugucauuuggugucaaaacaaaaguuucaauu

SEQ ID NO: 7018 - RNA, 140 nt, Oryza sativa
ucuaggaguguuuguaggagcgccacgugaaaauguaggagcguauauaggaaguuuaauagacuuuuaguauauaauagauuucuaggauuucucuaauuuauuugagagucacguagcguuguaaaagcauuuguaga

SEQ ID NO: 7019 - RNA, 152 nt, Oryza sativa
aacuauuugcaucgaauuugaaagaaaaagguauacgagaggauauccccuugagggauuagaauccacucccuauaagcucuaauggauuaagguuguguucguuuguagagcuuuacaacuuuccacucucauuuuccgugcacaugcuu

SEQ ID NO: 7020 - RNA, 59 nt, Oryza sativa
aucgaacuagaagggccagguuguauuugugcuucuccuggcacucccuugguuuuuau

SEQ ID NO: 7021 - RNA, 63 nt, Oryza sativa
uggcaaugagaggacgaggggaacggcggcgguggcccgcgcugcugcucgucguccuugccu

SEQ ID NO: 7022 - RNA, 84 nt, Oryza sativa
ggaaauugaacuuaaauccuuaaucguuugcuagauuuuucuugugagugaccuggcagagauugaucgaggaauuguauuucc

SEQ ID NO: 7023 - RNA, 247 nt, Oryza sativa
cuggcaguggacggagcgauggugggcggcuggcggugggcagcgggaggaagcggagcugagcagcggcggggcgaaauggagcgacagcgggcggugggcagagcgacaagggcgaagaggccggugagccaccgcuccucuuccgccuucccaucggccacccucuccaccggcgcaacgcgcgccaccgcuccucucccucccacccaucgacuggugugcaccgccaacccuuucccgccgg

SEQ ID NO: 7024 - RNA, 208 nt, Oryza sativa
gccccuuugcuagcuagcugagcaacagcccaaaaacaaggaugucuuggggacucauaugcacagcagcaugaguaaaauguugcaccuugggagugagaggcauuugcaauccaauauaauuaagcaugugaggcauccggaauucaguuuugucaauaugcauaccuugaucacugucugcucgaugucagguugcgugaggggu

SEQ ID NO: 7025 - RNA, 107 nt, Oryza sativa
uguuugaauugguggggcuuaggcuuaaugccuuuggaugggcuauaaauggaauuaaaguucccacuaucugaaggaauugggucuaaucucuuccuauccaaaca

SEQ ID NO: 7026 - RNA, 201 nt, Oryza sativa
uuaauagauaacgcaauugacauuuuaucacacguuuaaucauucaucuuauuuaaaaaauuuacguaauuauaaucuauuuuauugugaguuguuuuaucacuuaaaguauuuuauucgugauucaaaucuuauguauuuauauaaaauuuuugaauaagaugaauagucugauaagaagucaauggcguuaucuauuaa

SEQ ID NO: 7027 - RNA, 232 nt, Oryza sativa
gugcucccuacguuuuaagguuauaugacguuuuaacuuugguuaaaaccaaacuacuucaaauuuaacuuaguuuauauaccaaauuaguuuuaugaaaucaauagcugaauauauuuuuauaauaaauuuauguugaguugaaaauauuauuauuguuuucuacaaacuugaauuaguuugauuuugaccaaaaucaaaacaucugauaaccugaaacgggucgguccac

SEQ ID NO: 7028 - RNA, 332 nt, Oryza sativa
acuaggggcuaaccacucuuuucacuuugagcuaggaauacuugcaagguguuguuuuuuuuucuccuccuagaccuguucuuccucuccccugcucucucucucucucucucauguucuuccucccacuccucucucuccuguuuugguuugagccucaacgugauggugagcaucuccuguuugcgucagcucaugggaugaaacuucugccccaccaugaugguggacagaaaggggaaggagaacucaaggaagaagaacacagguccagagugcaacuucuuacaagaauuccuagcccaaagugagaagaguggguagccccuauu

SEQ ID NO: 7029 - RNA, 176 nt, Oryza sativa
uauuuucaccuuuguugcaauuuggacuacccuaaaccacuucuucagcacaucaauuccagcccaccggugaacuccuccaccucuuugcagauucauaucuuugcuggaggagaggccagacauggcuagggaagagaguugaggugguccaaagugcaacaaaguaaaaaaua

SEQ ID NO: 7030 - RNA, 111 nt, Oryza sativa
aaguaacuuguuacggcauuaaaaguaaaucuauuguggguuuagaaacauaagucuauuuggaaauuaaccccacaauggauuuacuucuaauguugugacaaguuacuu

SEQ ID NO: 7031 - RNA, 195 nt, Oryza sativa
gagagcaauuaucaggaccaguaggcgaugguaaugugucagagucuucuucaacaaugucaauaggaugugcauagguagacacaucauucaauccuucauggucacuacuaccagauuuguuaucaaugucgcagcauguuugcuagucuauggcaagagagccauucguauuacugccugagaaaagcucuu

SEQ ID NO: 7032 - RNA, 195 nt, Oryza sativa
aaaaucacacauguagaugaggugauguuacacacuuuguuuaucauauauaaaaauaacauuuuuuuuggacaaaucaucaagacauuuuucuuguucaaacuuuauuauuuuuauaucucacaaacgaagacaaguuuagacaagauuuuauauaugguuguguagcaucguauuaucuacaugugugguuuu

SEQ ID NO: 7033 - RNA, 156 nt, Oryza sativa
uuuggucaaauuuaaacuacucuaaguuuaacuaauuuuauaaaaagauaguaauauuuuaaauaaauuuucauaauauauuuauuuuggguuaaaaauauuacuacuuuuuucuauaaaauuagucaaacuuagaauaguuggacuuuaacuaaa

SEQ ID NO: 7034 - RNA, 91 nt, Oryza sativa
caucaggaguugucaugccacauauccguccucacccugaccauuaguggagaggugcgcauuuggcggagcgguugcugucagcacugag

SEQ ID NO: 7035 - RNA, 60 nt, Oryza sativa
uccucuaucuccuccucgggcucaucgggcucagccucaaagcccgguggggagggagga

SEQ ID NO: 7036 - RNA, 118 nt, Oryza sativa
uaacuugcacacggauguagaaauuggugauuuuacagaggcguuagcucaagaauuauaguaugcauucgacacucugaauaugaucugaauuuuguuacaucccugaaacaagaaa

SEQ ID NO: 7037 - RNA, 261 nt, Oryza sativa
uacaaguuguacgaaaccauagggauuuuggcaugugacauauauaauauuaguauuauguauuaugguucuaaaauuucacaaaaccacaaacguuaaccaauuuuacauacuuccauacuaauaaauuucagaugugauuauagaacacaaaagugugauagauuaaaguaaaaaugauguauagugugguuuugugaaacuugguuaugugccacaugguaaaacccuagugguuuuugugcaaaaguuuacucuugg

SEQ ID NO: 7038 - RNA, 89 nt, Oryza sativa
uuacgaggcaugagcagccggaccaugggauauucaggcacuccugguguuucacauuccuaauggccucuacuguagcugccauguaa

SEQ ID NO: 7039 - RNA, 192 nt, Oryza sativa
gaauuggaagggugauguggagcguucggcaauguuggaaugacaugcagcuucgaagacauucuugaugcuuuccaagccuauagcuguacagagauggagggaucucaugcaguuuucuuagaaaguuugaugcauugugucucacucugaucaauggcuuagcguuuuguaugcgccuuuuaccuuguc

SEQ ID NO: 7040 - RNA, 140 nt, Oryza sativa
aguuuuuuuugauagagccgacaccuauacuuauauuauaggugucaguucuagagaaaaaacuggcaccaaaaaaacgacaccaaggugaaccgacaccuauaauauaaguauaggugucggcucuauuaaaaaaaccg

SEQ ID NO: 7041 - RNA, 84 nt, Oryza sativa
aacccucagauuggggauuuccugccggaggaagcuuuuuggaggagcugccuuugggaggaacucuuccaguucugaggguuu

SEQ ID NO: 7042 - RNA, 103 nt, Oryza sativa
ggucuacgguuugugccauuaggucaaucagccagcucuggcuaguuuaucugguaugcaaagagccagagcuggcugauugaccuaauggcacauuauagac

SEQ ID NO: 7043 - RNA, 103 nt, Oryza sativa
gauaaaaugcuacuaccucuauccccaaauauaagggacuuugccuauguaauuacauaggcaaaauccuuauauuugaggauggagguaguaucagcuuagg

SEQ ID NO: 7044 - RNA, 82 nt, Oryza sativa
ccaucccgcgcgugaagagcucgccggcggccauggccaucuccaccgccgcgccgaugcugccuugccgacggcgauuggg

SEQ ID NO: 7045 - RNA, 82 nt, Oryza sativa; identical to SEQ ID NO: 7044

SEQ ID NO: 7046 - RNA, 126 nt, Oryza sativa
uguuuuuuuucuuuuugguugaaucguccucucuuguucuuguuaaggugggggcaccaauauaucaccauggugccagccaucucugcgagaaggggauagaucgacgcgucaagaaaucguuuc

SEQ ID NO: 7047 - RNA, 214 nt, Oryza sativa
uggcaugccauguguagccacauuguaagggaguccuugugcacauggucaaucucgcagaaagcccacugcaauccaaaucuucuucacgauuguuccuauucaccaaaucacccgucuucucgaaugaccgcccaccauuucccucuguugcuguugcuaacauccauggcccagggacccacuugcagcguggcuacauguggcaugccac

SEQ ID NO: 7048 - RNA, 86 nt, Oryza sativa
gacgaggaugugaucccuccuaacauaacaaaucuagauaaccauuuaucuaaauucguuguauuaagagaggguuaacccuugua

SEQ ID NO: 7049 - RNA, 79 nt, Oryza sativa
auaucaauuagaggaaagugggcaguuggguuaagcuuauucuguuuucuccaacaaucauuuuccucucauuagaccu

SEQ ID NO: 7050 - RNA, 338 nt, Oryza sativa
aauugcauaaugcuccggauauuauggcauguagcauauaacccuagucauuaugguaucaagguuucgcaaaacccagcauucacucaaaucauaaaaaaaacaacuuguugacacauauucacuucauuuuucaugccauaaaccacuauguauuguucaaauguugguuacuugaucaggaugaccaguuuaaucagucaacguuuugaacauuauuaugucaaggaugguaaaauuagcugaaauuugaacuaggauggauuuuaugauacuucuagguuauagagcauaggguuaugugccucgagucauaauauccggagguuuaugcaacu

SEQ ID NO: 7051 - RNA, 85 nt, Oryza sativa
aaaccaguuuugggaaaaaugggcaguugaguucggccaauuuaucuaugguuuccucaacaaucauuuuucccacauguuauca

SEQ ID NO: 7052 - RNA, 170 nt, Oryza sativa
gucuaccggaacuacaccuacgacgaguacuacaagaaguucuggagcagaaaccucgaccaagaacacugcuuggagcucuucagaacaacaccuacagacacaucuugaauucuugaucuagucgagaacugguuuguaguacucgguuguagguguaggugguguuu

SEQ ID NO: 7053 - RNA, 398 nt, Oryza sativa
cguccaaacaaguccuccaaauuaauuauuuggguuaauauaguucuuggauccaaaaaagugccacgugagcaugccaagucauccucacaugcagcgguaugaaugaaaugaccauucuacccuuauauaccaccuagaaaagaaagaaaaaaaagaagauaaauguuuucacacguguauguucguuuuagaauugucacuuacgauuguugcuggccuguuauuuuuuucuguuuguguuuuuucuuucuuuuuuauaugguauauaaagguagaauggucauuucauucauaccgcuacaugcgaggaugacuuggcaugcuuacguggcacuuuuugugggucuaaggacuauauuaacccaaaugauuaauuuggaugacuuguuuggucg

SEQ ID NO: 7054 - RNA, 321 nt, Oryza sativa
gggcgaugaggaaucuucuggaagguguggugccacuccggcagucgcagccuccucaacaugggaauggcgacaguuggguugaggaggcuagagguuuccgcucuucaucgauggcugucuguccuugccuccucggcccucgcugccgaugaagaacaagaaguuauccggcggcgagggccgaggaggugaggacggacguccaucgaugaagagcgaaaaccuccagccuccucaacucaauugccgacauucccauguugaggaggcugccacugccggaguggcaccgcaccuuccaaaagauuccucaucgcc

SEQ ID NO: 7055 - RNA, 167 nt, Oryza sativa
uuacucccuuugucccaaaauauagcaaccuaguacuggauuagucaccaccuaguauuaugaaucuggacagagagggguuggacagagggcucuguccauauucguagugcuagguggugucuaauccaauacuaggcugcuauauuuuuggauggagggaguag

SEQ ID NO: 7056 - RNA, 487 nt, Oryza sativa
gaguaaaaugcacuagcgguccuuaaacuuaucgggagguuucacuuaaguccacgaacuugcaaagcgcacaucgaggucucuaaacuugguuuauuguaucaucccgguccaaagccacguuugauuguggucuugccuauguggcacgccacgugaaugaugacauggaauuuuuuuuauuuuuuucucccuucuuccuucuuuuuucaccacugcgacaaccccuccccucguuccgccucucaccaccgagaaaaaagaaggaagaaagagaaaaaaagaaggaagaagggagaaaaaaauaaaaaaaauuccaugucauuauccacgugaugugccacguaggcaagaccacagucaaaugcggcuuugaaccggaaugauauaauaaaccaaguuuagggaucucgaugugcacuuugcaaguucguggaucuaagugaaaccuccugacaaguuuaagaaccgcugguguauuuuacuc

What is claimed is:

1. An expression vector encoding an endogenous RNA nucleic acid molecule altered to remove at least one naturally-encoded mis-match at nucleotide position 5, 9, 10, 11 or 12 from the RNA's Drosha cutting site.

2. An expression vector of claim 1 altered to remove two naturally-encoded mis-matches at nucleotide positions selected from 5, 9, 10, 11 or 12 from the RNA's Drosha cutting site.

3. An expression vector of claim 1 altered to remove three naturally-encoded mis-matches at nucleotide positions selected from 5, 9, 10, 11 or 12 from the RNA's Drosha cutting site.

4. An expression vector of claim 1 altered to remove four naturally-encoded four mis-matches at nucleotide positions selected from 5, 9, 10, 11 or 12 from the RNA's Drosha cutting site.

5. An expression vector of claim 1 wherein the encoded RNA is miRNA.

6. An expression vector of claim 1 wherein the expression vector is provided as part of a therapeutic composition.

7. An RNA-based molecule comprising an endogenous RNA sequence altered to remove at least one naturally occurring mis-match at position 5, 9, 10, 11 or 12 from the RNA's Drosha cutting site.

8. An RNA-based molecule of claim 7 altered to remove at least two naturally occurring mis-matches at position 5, 9, 10, 11 or 12 from the RNA's Drosha cutting site.

9. An RNA-based molecule of claim 7 altered to remove at least three naturally occurring mis-matches at position 5, 9, 10, 11 or 12 from the RNA's Drosha cutting site.

10. An RNA-based molecule of claim 7 altered to remove at least four naturally occurring mis-matches at position 5, 9, 10, 11 or 12 from the RNA's Drosha cutting site.

11. An RNA-based molecule of claim 7 altered to remove five naturally occurring mis-matches at position 5, 9, 10, 11 and 12 from the RNA's Drosha cutting site.

12. An RNA-based molecule of claim 7 wherein the RNA-based molecule is provided as part of a therapeutic composition.

13. A method of reducing the effects of a naturally occurring RNA-based molecule in the liver when compared to a different tissue having higher Drosha expression levels than in the liver comprising administering an expression vector of claim 7 to a subject.

* * * * *